United States Patent 12,642,819 (COMPOSITIONS AND METHODS FOR TREATING INFLAMMATORY BOWEL DISEASE) - sequence listing, part 31

SEQ ID NO: 11 - DNA, 6771936 bp, Bacteroides thetaiotaomicron (residues 1,692,985-3,385,968 of 6,771,936)
  modified_base (409441)..(409538): a, c, t, g, unknown or other
  modified_base (3558274)..(3558372): a, c, t, g, unknown or other
  modified_base (3727974)..(3728073): a, c, t, g, unknown or other
  modified_base (6553667)..(6553765): a, c, t, g, unknown or other
  modified_base (6650754)..(6650897): a, c, t, g, unknown or other
aattccgttgaacgtaacgaatattcgtaccagcggagccggaaaaatagtgccaatggcaatccccaagatgatagcaataatgatgcgtggcagcaggtcgatcttgattttcttcattctgatagttatttgttgaccacaaaaatagtattttaatccaaaactagcgaacaaatgtgcttttcaagtgtttcttacataaacaatattttaaaatatataagatatggcaaatcagaataaaacagatatcgggttgatcggtctggcagtgatgggtgagaaccttgctttgaatatggaaagcaagggctggcacgtctctgtttataatcgtaccgtccccggagtggaagaaggagtagtagaccgctttatgaatggtcgtgctaaaggtaaaaacattgaaggttttacagatataaaggcttttgtggaatcaatcgccacccctcgcaagattatgatgatggtacgtgccggcagtccggtagacgaactgatggatcagcttttccctttgctttctcccggagatattctgattgacggtggtaattctaattacgaagataccaatcgccgtgtaaaattagctgaatcgaaaggattcttgtttgtaggaagcggagtgtcgggcggtgaggaaggtgcgttgaacggtgcttccatcatgcccggaggatcggagaaagcgtggccggaagtgaagcctgtcttgcagagcatcgcggcgaaagcgccggacggaactccctgttgccagtgggtaggccctgccgggtcgggacattttgtgaagatgattcacaacggtatcgaatacggtgatatgcagttgattgccgaggcttactgggtgatgaagaatctcattgatctgacgaacgaggagatggcggacgtttttgcccgttggaatgaagggaagttgcgcagttatctgattgagattacttctaatattttgcgtcacaaggataaatccggtgggtatctgatcgataagattctcgatgctgccggacagaaggggacgggaaagtggtctgtcatcaatgcgatggagttggggatgccgttgggcttgattgccacggcggtgttcgaacgcagtctctcggctcagaaggagttgcgtcatctggcttccaagcagttcttgtgcaagcatacattacctgtatataataaggcggaattggtgaaggagatattttctgcgctttacgcttccaagctggtgtcgtatgcgcagggctttgctgtgttgcagcgggcttctgatgctttcggatggaatttggatttggcctccattgcccgtatgtggcgtgggggatgtatcatccgcagtattttccttaatgatatagctgctgcttttgaggcggcggataagccgaagcatttgttgctggctccttacttccgtgaggaaatcaagtctttgctccccggatggaagaatctggtggcggaggcgatgaaggaggaattgcctgttccggctttctcttcggctttgaattatttttattcgctgacttctgacaatttacctgccaatctggtgcaggcgcaacgtgattatttcggtgcgcatacgtttgagaggaaggatgagctgcgcggacagttctttcatgagaattggacgggatacggaggggagacgaagtcggggacttataatgtctgagtacttttcttttgccttgatgcaaaagaaaggtaccaaaagaaaaaatcaaggctgcacctacggagctactccggctgcatctccggctaaagggcaggaactcgctccgctcaaacagcctgcccttcttcacgccggagatacagcctccgcttgacgctccttcggtgaggccgggagaccgttcggatggtaagttgtaggtgggggtagtagtgggtgtgtgggtgattatgcgttagggcggttggttgagattggtcggtttgtcggttggttgaggctggtcggtttaggtgcggtgatggatggataaaaggtaaaaagttaaaaatacgacgatggataaatttgcaatgattatttttggtgcttcgggcgacttgactaaacgcaagttgatgcctgcattgtactctctgtatcgggataaacggctgacggggagttttactgttttgggaattgggcgtactgtctattctgatgaagattaccgttcatatatacttggggagttgcagcagtttgtaaaggctgaagagcagaatttggagctgatgtcttcttttgtgtctcatttgtattatttgccgatggatcctgcgaaagtggagggatattcgcagttgcgggagcgtttggtagagcttacgaaggaggtcgatccggataatttgttgttctatctggctactccgccttcgctgtatggggtggtgcctttgcatttgaaggcggccgggctgaatactcctcattctcgtattattgttgagaagccgttcgggtatgatctggagtcggcgcttgagttgaataagatttactcttctgtgtttgatgagcatcagatttatcgtatcgatcattttctgggcaaggagacggcgcagaatgtgcttgctttccgtttcgccaatggtatttttgagccgttatggaatcgtaattatattgattatgtggagattactgctgtagagaatctgggtattgagcagcgcggaggtttttacgagacggcgggggctttgcgggatatggtgcagaatcacctgattcagctcgtagctcttacggctatggagccgccggcggtattcaatgcggataatttccggaatgaggtagtgaaggtttatgagtcgctgactccgcttacggagacggacttgaatgaacatatcgttcgcggacaatatacggcttcgggcaataagaaggggtatcgtgaggaaaagggagtggctcccgactcgcgaacggagacttatattgcgatgaagctgggcatcagtaactggcgttggagcggggtaccgttctacatccgcaccggtaagcagatgccgacgaaggtgacggaaattgtcgttcacttccgcgagacgccccatcagatgttccgctgttccggcggtaactgtccgagggctaataagttgatccttcgtttgcaaccaaacgaaggtattgtgctgaagatcggaatgaaggttccgggtgcaggtttcgaagtccgtcaggtgacgatggatttcagttacgcacagttgggcggcgtgccgagcggtgacgcttatgcccgtctgattgacgactgcattcagggagatccgaccttatttactcgaagtgatgctgtagaggcttcctggaacttctttgatccggtcttacgttattggaaagataatccggacgcacctttgtacggctatccggcaggtacgtggggacctctcgaaagtgaagctatgatgcacgagcatggggcagactggaccaatccgtgtaagaatttaacaaatacagaccaatattgcgaactatgaaactatctgttttcccgtcgtctatggagacagcccgttcgttgatattccacctggtggatatcatgaatgctgaaccggacaaaacgttcaacatagcagtgagtggtggcagcactcccgccttgatgtttgatttatgggcaaatgaatacgctgatattactccttggaagcgtatgaaactttattgggtagacgaacgttgcgttcctcccgaagattctgatagtaattatggaatgatgcgttccctgcttttggggatagtgcccattccttacgaaaatgtattccgcatccgcggagaagtgaaaccggcaaaagaagcggtccgctattccgaacttgtcagccagcaggtacccaagaaaaatggctggcccgaatttgacattgtgctgttgggagcgggagatgacggacatacttcctctatcttccccggacaggaggctttgctctcttccgaccagatttatgtgaccagcactcatccccgcaacggacagaaacgtattgcaatgaccggatttccgatcttgaccgctcgccttgttatttttctgattaccggaaaggcgaaggcggaagtggtggaagaaatttgccactcgggagatacggggccggcggcttatatagcgcatcatgcggagaatgtcgaactctttatggatgccggagccgcgatgtatgtgcggaatgactgaaaagagagagacaatataaagacaaagtatattatatataagaagagagagtaacattggagaagagagaagctcacggggtcgaagccgggagcttcttgcctatgtagccattcggttttgattcggttttatcaccggatatatcttatgggcgaaactaaaaaactaaaattaaaagaatatgaatccatttcaaaattcgttcggcggtcatatcccacaggatgtggccggaaaacagggagagaatgtaatatttatagtctataacctgacagattcccccgatacggttgataaagtaaaggatgtatgtgccaatttctcggcaatgatccgtagtatgcgcaatcgttttcctgatacgcaattcagttgcacgatgggatttggggctgatgcgtggacgcggcttttccccgataagggtaaaccgaaagagctgagtactttctccgagataaaaggggagaagtatacagctgtttccactcccggtgatttgttgttccatattcgggcgaagcagatggggctgtgtttcgagtttgcttctatccttgatgagaagcttaaaggggctgtggtgtctgttgatgagacgcatggatttcgctatatggatggtaaggcgattatcggctttgtggacggtacggagaatcctgctgtcgatgagaatccctatcattttgcggtgataggcgaggaggatgcggattttgcaggaggcagttatgtgtttgtgcagaaatacattcatgatatggttgcgtggaatgcgcttccggtggaacagcaggaaaaggtgatcggacgtcataagttcaatgatgtggagctgtcggacgaagagaagccggagaatgcgcataatgctgtgaccaatatcggtgatgatctgaagattgtacgtgccaatatgccgtttgccaatacttcgaagggggagtatggtacgtattttattgggtatgctagtacattcagcacgactcgccggatgttggagaatatgtttatcggcagtccggcgggcaataccgaccgcttgctcgatttcagtacggcaataacggggacgcttttctttgtgccgtcgtatgatttgctgggcgagttgggtgagtaaatcaccggacggtgcgaactagataaaacgtggtgggaagttcggaaaagatggttatgttttccggatttcccaccacgttttactctttgaactctgtttctttttgtactttcttccgaatttcatgaaataaaggggaaaaagtgagaggagtgagagaggatttctaacattcgtatttttttttagttgaaaattagagagtagaaacagtgaaataaaaatataaaagttgcaattcctccctcacacctctcacttttttaggataaacttctttttcctatgccctttgtactattgtcggatcattgggagatttctttaagaaatcgtttctgataacgtatgcatccatcttctctgtatcgaagggtttcagtaaagaagctatttcggctttgctcaatgagggattgagccatttctcttcctcctcttgggtgagtatggcgggcatccggtgcttggtgttatcgatgtaatcggtcagcgaattggtgtcagtggtgatgatggagaaagtttcgtgttcctctcccgtatccttgtccagccaacggtcgtagatgccggccatcgagaagataggttcatctttcacatatatataataaggtatcttgtttgctccttcatgcctccattcaaaatagccggtactgggcgctatgcaccgtttcttcatgatcggttcgcggaaagacggtttctcgaaaatggtatccgcacgggcattgagtgtcatctttcttatttctgtcgcatcctcttcgcttcttacccagaaagggatgagtccccagttgaaaacctgtacttcgtccgaagaagtaatgataggatatctggggaaagtgaacgcattcacatgatactgttcgtcaagaatgctttggtaaatctcgactacatccgattggcgtccgtaacgggcggcaactttgatggctttggctgacatggagttgtggaaacacatattatctgcaattaatgtttataatttggttgatatcagtagtataacgtccggagagctgttcttgtttgagcatccccctataaacaaacggagtcaagtctttgctcgcaaaaagaaatgcattaagatttaatagaatataaaagagctttatgtataatcaaactttatgttatttttctttgatttagtgctatcgttcagcttgttctataaatagataaataaaaagtgcttcctagatcgtccgccgacgaggaagcactcaacacaaaaactaaactagacttaactaaactattctattcttggaatttcacaatccctttctgttcgttgcaaagttacatataaaaccgatttctgacaaactataatcgacaaaattcacttttttgccgataaattcgacaatcatcagcttctttcatccaaaaatgcctgaaaaacctgcttgtaactatcactaatggggatatacgttttgtcaaagacgatacgtccacggtcgatcacccgtattttgtccttttggacgatgaatgaacggtgtacacgtatgaaccggctggaaggcaaaagctcttccatggctttcatgctcatgagtgacaagatgggtttggcatcatcttccgtatatattttgatgtaatctttcagtccttcgatgtacatgatctttttcagttctacctgtaccagcttatagtcgctcttgacaaagatgctgtctatctcttccggcttctgcaccagctcgaaccattgcagggctttattggccgcttgcaggaaatcgacatacgagataggtttcagcagataatcgagtgcattgacacgataaccgtcgatagcgtattgaccgaatgcggtggtaaatacgatacgcgtacgggaatctaccatttgtgagaactccagtccgttaagttccggcatctgaatgtcaaggaaaagaagatcgacttcttcgcccggcaactccttcattgcctgaactgcactggaatactttcctgtaagttgcagaaacggagtcttattcacataactttccagtaggcccagagccaatggctcatcatctacaatggcacaacgtaatatcataattctctatattttatttaattacctaaaccgaatatactctcaattattacctattacttaatacttattacttattaatactctcccttacacggatgctcagccttgatttgtactctttgccgtcttccgaaattcctttctgccaggtatactggcctggataaagaatctccagtcgtcggttcacctgttccagtcctatccccgaaccactcttgtccattatgttcttcgggtggttgctgttgcttatttcgcagatcacttccgtctcattttccgcaagatggatatggataaaactccgttccgtaggcgatatgccatgcttgaaggcattttcgatcagcgaaataaagataagcggtgtgataagagtctgactgtccggctgaatatcgatctgcgtagtcatctgtacattggaggacagacggatgcgcatcagttcgatatagttgcggataaagtcagtctctttgcccagcgggacataggtctgctgattatcatacagcacatagcggagcagtttgcttagttcctgcacagcctgttgcgccttgtccgtatcaaaagcaattaatgcatagatattgttcagcgtattgagcagaaaatgcgggttcagttgattgcgcagattcttcagttccgcttccgaacggctccgttccgcttccttgcgggcagcttccgcctgtgtccatcgggcgctcatacgtatggcggcactcagtccgatagtgaagacgagactcagcatatctctgacaaagaacaaccatcccggaggagctcccgatcggtgaggtttgggaacaaaggaaggatcgaatgtcagactccgccaaaggtgcagcatcagaccgatgacacacaacaggaggatgttgtaagtaatatacctcttggtctggctctggaaaagatatcggggaaccagcaagaagtagttgacgtagaacgcgatcatgaaagacaacggtacggcagaatggcgtaagtatgccatccagttgatgtttccgttttcgcgctctacaaagaagaacggaaaaccgaacataatcccccagccgataatatgtatcagtgcttccaggggacgacgtgcggatgttaggctttgtttcataaagacaaagatagttttttattcgtatctgatagcctctatcgggtctaaatctgctgctttctttgcaggataccatccgaagaagactccggtgacggtgcagacagcgaaagaaaggaagacactccaaggttggatgaagataggccagtgtgccacgctcttcacgatccagctggctccgcagcctatgatgactccgataagacctcccgtaatactgatcatgatagcctcgatgaggaactggctcagaatatcaacgccacgtgcgccgacggacatacgcagaccgatttcacgggtacgttcggtgacggatacgtacatgatattcatgataccgataccgcccactaccagagatattccggcaatacaggcgagcagggtggtcatcagatcggtggtagagtttagcatcgtactcaactcctgttgggtacggatggtgaaatcgtcttcgtccgaagctttcaacttatggttgcgccgcaggatttccgtgatttcatcggtagcatactccgtcatgtcttccgatagggcagaagcaaagacaccctgaagataggtgacggcaagcaatcgtttcatgacggtggtgtaaggagccagtacgatattgtcctgatcctgtcccatagagttgtaccctttggctttgagcacaccgaccacccggaacggtatcttgttgaagcggatgattttccctatcggatcgcttccgtccggaaagaggttgtctacaatcgttttaccgatcacgcagaccttagccgaactttgtatatcggcttccgtaaacatatctccactttctacactcagctgacggatgtcgagatactccagcccgacaccgctgacggatgacgggtagttgttgttacccgcgataagctgtcccgacgaagacacattaggactgatggcggacaggaaattggtctcatcgcgcaaggcctcatagtcggtcagcttcaacgtctgcatagccgatgggtcttgccggacaccaccccgtctgtcggctcccggatggatcatgatcatgttcgatcccatctccgatatctgttgctggatgcttcgcttcgatccctgaccgatagcgagcatcgtgatgacggaagcgacaccgatgatgataccaagcatggtgaggaaagcacgcagcttgttgttcgccaatgcccggagagctattttaaataagttagttccattcataaactactgttacttattacttaatatttgatacttaatacttaatacccaatacctaatacttattacctattacttatcttcaatcctcgtcgcttttgggcaatgcggccagtgcttcggcggcggacaggacatgagagttgactgtatcttcaatgacatgaccgtcgcgcaggcggatgttccggctactgtattgcgcgatttcgggattgtgcgttacgaatataatggtacgtccttccgcatgaagtttctggaacaggacaagtatatcaaaagacgtacgtgtgtcgaggtttccggttgcttcgtcggcaaggatgaccgcagggttgtttaccagtgcacgggcgatggctacgcgctgcatctgtcctccggacatctggttggacttatgctccaaccggtcgcccagacctaccgcctgcaacgcttcgatggcacgccggcgacgttcggaagcgctcactgatgagttgtacatcagcggtaactctacgttttccacagccgtcgtcttgggcagcaagttgtagctttggaagacgaagccgattttccggtttctcagtacggcacgctgaggcttgctcatggtgcgcacggagatgtcatcgagcagatactccccgctggtaggagtgtccagacagcccaacgtgttgagcagtgtggactttcccgaaccggaagtacccatgatggtcacaaactcaccttcgttgatggtgaacgaaacgccccgtaacgcatggacggtttcttctcccacctgaaagtctcgtttgatattttgaagttcaattacttttttcatacttggctacttgttgcttttctttttgttgtttcccggagggcctggcatgaacgggcttctttctccgtttccctgattggattccgcatctatattctcgcccggcatagcgcctatggtagcttctgtgaccactttggttccttcggcaacgccactgatgatctctgtggaaataccgttactgattccgatttctaccggatgagccgtaaaggtggttccttcgcgcgtccataccttatgttcgccttcgcaatctttcacgatgtcattcttaccgatcaacggtgcttcgggggtgaaacgcaaagctctgttggggacagacaatacatctttcttatcaaggataaagatagttacattggctgtcagacgcggtttcagcttcaagtccggattcggagcagagatcaccacttcataagtgactaccgtgctggtacttgaactggcgctgctgctactgcttgcatctcccagacgaatctgtgtcacgactccgtcgaacacatcatttggataagcatcgacagtaaagctggcgcgctggccttcttcgataccgcctatatcagcttcatccacgtctgccactacctgcatctgtgtcaggtcggccgcaatggtgaagagggtaggagtttcgaacccggaagctacggtctgtccggcttctacatcgcggctgatgacaactccgtctatcggagaagtaatcgtagcgtatgacaggttacgttctgcctttgccagagatgccttgctgctgtcgaaagcgctcttggccttctgataattatagagagcctgctcgtagtcggtatcgctgatcaatgacttgtcgtgcaatcctttgctacgttcgtagttcttcttctgatattcaaattcggctttggcaccatcataagttgcctgctgggatgccagttcactctgtaaagtgacacggtccatttcggcaatcagctgtcctttggttactaccgagttgtaatctgcataaatcttgtcgatgataccggatacctgcgtaccgacttctacttctatcaccggttcgattgttccggtggcagtcaccgaattggagatatcgcctttactgacagtcgcactggcatacgtcaccttgtgctttgccggggaacctgtaaagaaccagattcctccgcccactactacggcaactgccacagcgatcaggataatctttttcgttttcattctatattctgtttttacttatttatattccgcttttagtaaggaagaaggcttataatgccagtttgtctccctgatagaacttcagcaactgagtgttcagtatcgccatgtatttggcttgaagctgctcttgctgtgcttgcagcaagttgttcttttccgtcagcagctctactgtattcttcatgcccagattgaactgttcgctgatcaggtcgtagctgatctgtgtacttctcagcttctcgttcgctgccgcataacgttgctgtgcactgttcgcatccagccagagtccttcgatggtcttatacagcgttttctgttcgtcgagcagcgacagcaaactcgtttcgcgctgtaacttcgctttctgcacggcactcttggtctgacggttattgaagataggaacgctgacggaaacaccgatggagttgttccatccgttctttacctgttctccgaaggtgaagtcactgccgctggtgtggttcgttccgatacctgcactcagactgatggtggggagatatcccgctttggcgatatcgatacccagttccgaagcctctacgctcagtttgctcgcctcgatttccggacggagggtgagcgcgctcatatacacatctttcttggtgggcaatggtaaaagtacgttttcgtcggacagggcggggagatagacgttcatttcattttccccatccaattcgagcagttgtttcagttgtaatttgtagtcctgcagagtggcttgcgctgttactaattgataacggtcggtgctgacctgagcttccagttgtgccagatcacttttggcaatgcttccgacattcagaagttcctgtccgcggtcgcgttgcgcaatggaaacttgcagcgtattttcattgaccttgacggactccgctgcatagagaatctgaatgtaaatctgagcaatagattcctgaatactattctcggacgtttctacatccagattggctgcctgattgttcagcttctcctgtttgatggtgttcagtcgcttgctaccattataaatggtccacgaagcattcagaccgtaattgccattgtaactggtcttgctggttgtctcgatcacctcgcttccgctgatcgttctgcttgattcctgatatggacggttcaccatgttctggctcgtagagaacgacagactggggaacagggtagctttggctgtcttcacatcgatctgtgtactttccgcattcacccggtttttgcgaatcgtaatgttctgttgcaacgcatagtcgatgcacgactgtaaatcccattgggcggggagattcatctcgctctgggcggctgtctgcacagaagattcctgggcggatataccgggcagcagacccgctccaagaaatactatcactgtcaatcttcttacatttatcatatttttatatgtctattgatttactggaacgaaggtacgtacatattatattagctgcaaaagcgatagacagatggcgctttttcgccgttaaatgttttttttctgtcgataggcaggttttttgagaaaaaccatacaaatcatgcaacattttgccatacttgtttgttttaattataaaaattgtatatttgtactcattacaaattctaaggtcagcttatgaagaatacactgcttgcaatatggaacttttatttggagggtttccgtagtatgacgttaggtcgtactttgtggcttattatcttagtgaaattattcattatgttcttcatcctcaaaattttcttctttcccgactttctcggcgatcatcctacagatgccgacaagggtacgtatgtgggaaatgagctgatacagcgtgcacttccggagaaaaccactgatttttaactcttaaactacataagattatgattgaaagtattgacacctcgctgatcgattggtcgagagcccaatttgcgatgacagccatgtaccactggattttcgttccgctcaccctcggactggctgtggtgatgggaataatggagacgttgtattataaaacaggcaatgaattttggaagcggacagccaagttctggatgaaacttttcggtatcaacttcgccattggtgtagcgacaggattgatcctggagtttgagtttggtacgaactggagtaattattcttggtttgtaggtgatattttcggtgcaccgcttgctattgaaggtattctggcgttctttatggaagccacgtttatcgctgtcatgttcttcggatgggataaggtgagcaaacgcttccaccttgcttctacctggctgactggtctgggggctacgatctccgcttggtggattctcgtagcaaacgcatggatgcagcatccggtaggtatggagttcaatcccgatacagtgcgtaatgagatggttgatttctgggcggtggcaacttcgcctgtagcggtcaacaagttctttcatacggtattgtccggatgggtacttggtggcgtgttcgttgtaggaatcagttgttggtttctgctgaagaaacgtaatcgcgagtttgcgcttgcaagcataaagatcggtgctatcttcgggcttgtctcttcactgctggctgtatggacgggcgatggttccggctatcagattgcacagacccaaccgatgaaactggcggctgtagagggactttatgaaggaggaaccaatgtaggtctggtgggaataggaatgctgaaccccgaaaagaagacttacaatgatgggaaagaccctttcctgttccggattgagatacccagtatgctttcgttccttgccgagcgggatgtggacgggtatgtccccggaattaccaatattatcgaaggcggctatcagctgaaagacggtacgactgctttgtcggcagccgaaaagatagagcggggtaagaccgctatcggagcgctggctgcttatcgtgcagcgaagagcgccgggcacgaggaagatgccgctgttgcctatcaggttttgcaggagaatatgccatacttcggatacggatatattaaagatgtgaatcagctggttccgaatgttcctctgaacttctacgctttccgtataatggttatcctgggcggatattttatccttttcttcatcgttgtgctcttctttatatataagaaagatttgagtaagatgcgctggatgcattggatcgctctgctgaccattcctttggcttacattgccggacaggcaggatgggtggttgccgaatgcggtcgtcagccttgggctatccgcgatatgcttcctacatcggcggctatctctaaattggatgtaggctccgttcaggctactttctttatcttcctgatcttgtttaccgtaatgctgattgcggagatagggattatggtgaaggcgattaagaaaggaccggaagaagagataagtaataggtaataggtattaagtaataatcgtagctgctgactgatttatcagcatggttattacttattacctattacttattacctgttacttattacttaaaacttaatacttacatattatgtatatatttctacaacaatattggtggctggtcgtttccttgctgggggccatacttgtatttttattatttgtgcagggaggaaattctttattgttctgtttgggtaagacggaggaacatcgtaagatgatggtgaactctactggacgtaagtgggagtttacgtttactacgctggtaacgttcggaggtgctttctttgcttcgttcccgttgttttacagtaccagtttcggtggggcttactggctttggatgattattcttttcagttttgtgttgcaggctgtgagttacgagttccagagcaaggcagggaatttgctgggtaaaaagacctatcagactttcttggtaattaatggggttgtaggacctctgttgctgggtggagcagttgctactttcttcaccggttctgatttctatatcaataaggcgaatatgacggatacgattatgccggttatcagtcattggggaaatggatggcacggactggacgcgttgactaatatctggaatgttattctcggactggctgtattctttttggcgcgtgtgttgggttcgctctatttcattaatagtatagcggataaggaactgaccgataaatgtcgtcgtgcagtattgaataatactattttcttccttgtattctttttggtatttgtaatccgtacattggtttctgacggttttgctgtcaatccggatacattggaggtttatatgcagccttataagtactttatcaactttatagaaatgccggtagttctgatcatcttcctgataggtgtagtattggtactttttggaatcggtaagacagttctgaaaaagactttcgacaaaggaatctggtttgcagggataggtacagtgctgacagtcttggctttgttactcgtagccggatataataacactgcttattatccttcatatacggacttgcaaagttcgctgacattggctaacagctgttcgagtgaatttacgctgaagactatggcttatgtctctattcttgttccgtttgtgatagcttatatattctatgcatggcgtagtatcgaccgccataagattacagagaaggagatggatgaaggaggacattcctattaaatataacttttcctaaatggaataaccgattgaatattttattgggatttaccggaaattccccttatataaggcaatttctatgatatggagttgacttacataaggggagttcttttaattataacatcctctgtaatagcttttcttttatgtaactcatctatcgtgtttcaagcagagatatctttttgggtattgtcagtactcttggcaaataataaatatactaacaggaagatattcgctattggaacgattaataccaataaccacagaccggataacgaaatatcacgcaatcttttcatacattgtgcaagaaaataccataatgttatgagaatcataactgtagttataaacagaatgattcctccccaaaaacttaatgaaggtgttgttcccgttttgtaatcgcctccaaagtgtataaatagatcaatcatggatattgctagacatacaatgaaatttataattgacagaatcatggatagcagaaactcttttctattaattgtgcctttcaggttaaactttaattcgaacatattcgtgaggtttattagtataagatttaatttccttttaaggaatggtaagatggggtagagtataaaggctgtttcaaaataaaaaagaaacagccttttccgtattattcaaatatatagtcttttacttattcactacattttccggtgttccggagatataagcctgtagattgctaatggcaatattcatcagacgctcacgagcttctgtgcttgcccacgcgatatgcggagtaatgtagcagttctttgcagtcagcaacggattgtcggcacgaggaggttccgaagaaagtacatctactccggcagcataaatcttgccactgttcagtgcatctgcaagatcttgttcgttaaccaatgggccacgacctgtattaattaaaatagcattcggcttcatcagagcaagacggcgtgcgttcaccaattcgtgagtttccggagtgagcgggcagtgcagactgataatatcacattcgctgaacaactgatccaaatccatcttcttgatttccggtggcaactggaagtgagactttgaagtcaaagcatatacctgcataccgaaaccgatggcaacgcgagcagtagtatatcctgtatttcccaatccgacaagaccgattttcttatcccgcaattctatcaacggagtatcccaaaaacagaaatccttgttattggtccaacgacctttgtggacttcttccgaatgatgctgtacctgctgacagatattaagaatgtgcgcaaataccatttgtgcaacggaagctgtgctatatgcagggatattagttacaataataccacgttctttggctactgccgtatccactacgttgtatcccgtagcaagcacaccgatatacttcagttcgggcaaggcagtcatgtgatcggcgttgatgattactttattcgtcagaatcacttcagctccggctgcgcgttccaatacttcttcgggggcagtacggtcataaatggtacattctccgagagctttcaaaccttcccatgataaatcaccggggttggcggcaaagccgtctaaaactactgttttcattatatttaagtattaagttataagtattaagtattatgggatgttcccattgttctttagttttacaattgttgctgtcagtaatttaagtatttccagacagtcagtattaatagattcatattgttcatcgcttatatattctgtttgctgaagtaaatatagccaatattctgtttcagaacattccttttgagaaatagagtatttgtgtataaagtcaagatgtgattctgcataaatagcttctctaatattagcaccgatagaagttccactacgtaatatctgttttgatagaattgtttctttcttgcaatctcttaaatacttatatagattaattattcgaattgcaaatttggtagacttctcttttaataaattttctttcacggctacggctaatacctaatacttaatacctaatacttatttgaacctttctccccataactgttgcatccgttctgcatgcttctgttcggcggcattgttctgaggttgccatattcgtttttctttcagctcgtccggcaagaattgttgcttcacgaagttgccttcgtagctgtgggcgtacttgtattcctgtccatatcccagttgtttcatcagcttggtgggagcattgcgcaagtgcagaggcacaggcaagtttccagtggaacgtaccagttctaatgcatcgttaatggcactgtatgccgaattgcttttaggactcgttgccagatagatagttgtttccgccaaagggatacgcccttcgggccaaccgattttcatcagagtttcaaagcaggcattcgccagcagcaatgcattcggattggccagacctatatcttcggcagcagagataacgagtctccgtgcgatgaaagcagggtcttcaccaccttctaccatgcgggcgagccagtaaatagccccgtctggatcactgccacggatagacttgataaaagcggaaatgatgtcataatgcatttccccgtccttgtcgtaagccaacggattctgttgcagacgttcggtcaccatgtcatcggtaatgacaaccgtttcctctgtgtccgattccactacaagttcaagtatattgagcagtttacgggcgtctccgccggagaagcgcagcatggctgtcgtttctttgagttcgattttccgttctttcagtatggtgtcggtggtgatggcacgttgcagaagttcgagcaaatcttccttttccaaagatttgagcacataaagctggcaacgggagaggagagggcggatcacttcgaatgatggattctcggtcgttgcgcctatcagcgtcaccgtaccgttttccacagctcccaacaaagaatcctgttgcgacttgctgaaacgatggatttcatcgataaacaagatcggactggattgcgagaaaaagcggttgctcttggcacgctctatcacttcgcgcacatctttgacgcctgaagtcacggcactcagcgtataaaacggagtttccagtttattggcgataatctgtgccaatgtggtttttcccactccgggaggtccccagaggataaacgaagaaatacgtcccgcatcaatcatcttacgcaggatagcccccggtccaactaaatgtttctgaccgatataatcatccaatgtctttggtcgtaaccgttctgctaaaggttgcatagtcttagaataccattaataccatgaaacgaataccgttcttgttgatacccggattgtcacggtaggtgaaacgatgtacatattcaacgtgcagcaacttgaaaatgttgtagatacctatacttccttcgatatacggcaccttcgggtccatcacgaaactggtgaatttaccgtcgcgtgtcgggaaacggaagaggtcggggttgctgctcttgaatggattgtttttgtcggtcaatgtcccccacaatgcgcggatacggaacatttctctccatttcagattcttgatcagcgggatgcggttgaacaactttccgttcatgtcataagaaagtgacatggacgcataccggtcgttcaggaattccatattgttgatcagggaaaatgtctcacgttgagtgatatatgacaagttggcttccggcagaatcaatagcgggaaaggtacgacattccattctgcccctgcttttacgctacagtctatctttccccacgaagcaggaagccagaaacgtttccagatgcttgcttccgtgcggttgaagttgtattctccgcccagcacgcctttgaagcccatggcatgagtcagcgtgaagataggagcgtccagcgacaccggaacacggcgctgcttggagttgacgaaagattctcccggagcataacgcagtgtcacactcgcttcggaagtcgtgatgtcatgcacacgggtttgtgcggcgtcattccgcagatattccagttttccggtaggctcgtcatttcgatggcggagcatggctttcactccgaatcccgtcagcgtttcgagttcgtagttgatggtagcatcacgcatatatgacatctggtctaccgttgtcgtcttcatcgaaaggaagatgttgtctttgtccgtaaacagaaacttgtccatcggcgacattacatcataactgtacgttgcagatataaaatgtttgggaaactcccatactacataatctcgtttgttgaaagaataagtcagcgttccgctatatttccacttttcgtcttttagaccataagctccgtatccgctcaggaaccaatgcttgtcaaagtgagcagtagtcataccgctcaggcggaaacgggttccgtcgatgtagttgcttgaaatcatggtgttgataggaccaatatccactttgctcttatgctctttgctgcccgtttccacaaagttctcgatcaatgctttcgcaccgaagatgatatatttgaatcccggaatctgttccagacggttgacgaatacatccatattgctttcctttctggtcaacggcacctggcgtacactcgcccagtattcgtcactcttcgaaagcatgtcggcctccttgatcacaggacctttcaaacggaacaaccgctgttctatcggatcaaacttataattgctgtatttagtcgttcgttctacctgtaaccctcccgaggttttgttggaactccatgaaaggtctaccgtcatgtcgtcatccgccaatacccagttcccgttgggaagctgctcgtactgctgcacgatgtccatgcggttgacaaagttgacgccactctttttaggcaggttcatcgtacacttctgaacggcataggtcgaatctttcagcacataaagatggcctgtaaatccgaaatcttgtgagttttgcggtacgaacgtcagatgtacgcattcgcgcttgttcaccatcagcgtatccatcaggtagtatttatagaatgagatggcattgttgccgatagggcttacgaatcgctgttggagcagccggatgtcatcatcatagatgttgatatcggcaaaaacatccttcagaacagtccccagcatgtctcctgtggagaaaaactcttcgataccgttggaattctttcctttgataatggtctttttgctttcggggtctttccggaaaatggtctgtgaggccgtttcctgtacggagatagggagaatcagtttgttggtcgtctccgacacttccacctggtctttgaggaatgagtatttcttgtagatacccttttccagtttctccggagtcaggtcgttgatcgacattttcattttctcgtacttgtcgtactggtagtaatcgttcacttcgagcacttgtgcttttttgtgttcgatcactttcttcatgaattcgactgccggattattcttgcgggagtatttttctttctgtggttttacgactacttcggtgagcattacatcgtccggagagagtttgacattgacagtctgatttccggagcctactttgacggttttggtgacatatccgatggaagagaaaacgagcgttcctccgtttctccgtgcgtcgagcttatattctccgtcaatattggtgacagtacccatttctctcttgtcttgataatagacagagatatacattagtggttcatgagtgactgaatcagttacaaccccctttatttgctgcgcaaaagcatttgaaactgcaaatacgactaagagcagtattattattttgttatatcgttgtatcataacgttcgtagtagggctgcaaagttaacaaataagtctgagtaaaatagagtatataactttttttacccatcgttttttgttatttacaagcttatattattcaacaatggaaggaggcagattgttttggtcctttttgtccttcccttttcaacgtatgtcacatcatgcgaaccgacttgctccgattgtcttccgtagttccaaaatcagtttcaaccgttgaaaccaaaagtttctcgccttgaaacaaagtgtttcaagcaatgaaacaaagtgtttcccggcatgaaactaaaagtttcaagcgcttgaaactttttgaaacacttaatgatcctgacagtgaccggcttcttctgtctggctattaagccggactcattgattcttgagtccggtcaaccactccggttatttacttgttaaaatttgtacgattcgttcggctgttcgtccgtcccagcgttcggggagctcgcctttcttccattcacctttcatcagcgtatccatagcctgagcgagtgccgccggatcttcgccgaccagttcattcgttcccacgcgccacgtttccggatgttcggcatatgtgttgagcgtgatacaggggatgccgaggaacgtagcttcttcggctacattgccggagtccgtgatgattcctttggctttattgatcagatatccgaagaaaagataattctgcggaggcatgatatgaaggttcggggcttctatgccgaggtttttgattgcattgcgcacgtaagtgtgcatgggcgctacgataggcataccggcagctttttcgatcattgtttgcatcaacttccgcaggttctctttgttgttgagcagtacacgtcggttgagggtaagcaggagatagttgccctcctgaagtcccagtacggagaaccataccggtttgagcagccggttccggttgaagcggacggtatctaccaaaatgttgccgacataatatacgttttcactttccgtgcctgtttgattcagatttcggttggccaccatgccggcggtaaacagataatcggatactccgtcggtaatcatccggttaacttccttcggcatcttcatgtcgaacgagcgtgtgccggctaccagatgggctaccttgattccttgtttcttggctacgatagcgcaactcatggttgctgtcagatcgtccactaccaggacgacgtgtgccggattctccgtcagctcctgttcgaaggcgatcatgattccggctgccagactggtggggttactgctttccactccaaggtagacatcgggagctttcatgtcgagatccgaaaacagggaagcatccagacttgtatcgtcccgtctgcctgtgtacaccaaacggtaggagatgcttttacccagccctcttgcggcttcgatggcgcgtgcgataggggctattttcatgaaattggggcgtgccccggcaacaattgttattttcatattgtttctatctaattcgtgtagcaaaagtacattttcttacggaatttattcgttactttgcatacaaaataacaaatatatgccgacattcgttcaaattcttgattttataggcacatttgcctttgctattagtggtatccggctggcttcggcaaagcgtttcgactggttcggagcctatgtcgtaggtcttgctaccgctatcggtggcggtaccatccgtgatgtactgctggatgtgacacccggatggatgacgaaccctatctatttgatctgtacgggacttgccttgatctgggtgatctgtttcggtcgctggctgatccgtctgaataataccttttttatattcgataccatcggactggctttgtttacggtggtcggtgtggggaaaagtatcgctttaggctatcctttttgggtagccatcatcatgggtagtatcacaggtgccgcaggaggtgtgattcgtgatgtctttatcaatgagatccccttgattttccgaaaagaaatctatgcgatggcgtgtgtagtaggcggcatcgcttactggctgtgcgatgccgcagggatggaatcttatgtctgtcagctcgttggcggatcggcggtatttgttacacgcatccttgccgtgaaataccacatttgccttcctatattaaaaggtagtgaagagactgacggcgattcttgaagattttatttcttgtccagatccacttctccccggtagctgattgcctgacggttctgcatcgtgacgtcaatgctggtggtgccgtcggggaacactttcgccctgaactcaaagaagtcttccggacttcgtgcggagaatttgataacggcgtttcccttcttatccatatccatcgtgtattctttgaggggagcgttgaatatcagcccgcttcctccgccataaggaacgctgtaagcacgtccgtaataagggaggtaagagaataccgaatcatttctgatttgcagtgagtattgtgaagtcagaggtatagaacgtccgcgcatgggcatagcagtgttgacgtctatcttgtagtcttctgatacgatcagctgtctgacagcttctttcttctgttccttcttctccttcttggtctgtgccgaaagagtcgggattcctgctagcataaccagcagtagcataaggatttgttttcttgttttcatatcagttacagtttagtgtatatatgtataacactcaaatatactaaaaataaggagtcctcctgctttctttaatgaaaattaaacagaaatccctagaactgttccagaatggagatgcgtttctcgataggaggatgcgtggcaaagagtccgctaagcccgctgagggcacttttcgactggtcgcccggattctgaatgaataattgcgctacatcgctacgttttaccgcttctatatccggatcatcggaaattttgcgcagggcacttgccaatgccaacggattctttgtcatctccgccgaaccggcatctgccatatattcgcgcttccgtgaaatggcgaagcgcatcagactggcaaagaagtaaccgacagcggctattactaaggcaatcagtatgatgaggatagctcctccaccgttttttccgttgctacgtatgcgcgtgtgcgtaatagtatagaaagtgatttgcgtcagcatcgagaagattccgacaaatacaatcgagacgatcagcaggcgcacatccctgttgcggatgtgagtcagttcgtgggcgatgactgcttccagttcttcgtcgttcaacttctgaataatccctttcgagagagtgaccgtataggtgcggtcgttgataccgctggcaaaagcgttcaatgaatcgtcgtcgatgatattgattttcggagccttcattccgtttgccatgcagaggttctcgaccagattgtagacacgtttgttttctctgcggtcgagaggtttggcacctgtggcggctttgatgatactcgtattcgcccagaaagctatcaggaaccaaatcaatacgacacccatcgtataggggagggcattgatgaaaagaggattagccaattccaggatacttacttccatgctttcaccgtgccccatagcagccagcagatagcaggccagataaagcaatgctgctaccaggcagggaaatagaaataacagaagaacagagcgccgattgttccggctctgctgtgtttggattccgacgtactgcatacgtgctcgtttttagaaactgatcttcggggcctgttccagattcgcacgttcgttggtacctaggtcgaacatgatttctctgcggaaacctgccatacctgctatgatattggacgggaatgtctgaaccgcattattatattccttcgtggccgagttaaagtaacggcgtacagcagccaatttattctctacatcggatacttcttcttgcagttgcaggaaattctggtttgctttcaggtccggataagcctccaacgtgattttcaatcccgataaagcggaagataattgattctctgctgctatcttttcgtcgattgtcttggcgctgactgcaccgttacgtgcctgaatcacccgttcgagggtatctttttcgtgtgcggcatatcctttcacggtatccaccagttgcgggataaggtcgtggcgctgtttcagctgcacgtcgatgtctgcaaaagcattttcacggttatttctcagtctcaccaatgagttgtacatggaagcaaaaatgattcccaacagtacgattattcctacgataataagtatagtcatgtcctttactttaagttaataatactacccaaaagtaagttattttgtattgccaagcaagaagaagagaataaaaaacgtcctaaaccacctaaaaactatcaaaaagcacctaaaatctatcatttgacagtttcaccccctaagaaatgacgaatttccccctgtttgactcataaaatacctttaaacttgcaaacgtcaagaaagaaacgaaatattaaccgtaaaacccttaaagtatgaaaagtttaagtttcagaaaagatttaattggagttcaggaagagttgcttcgttttgcttataaattaactgccaatcgtgaagaagcaaatgatttattgcaagaaacatcattaaaggccttggataacgaggaaaaatatgttcccgatacaaattttaaaggatggatgtacacgatcatgcgtaacatctttattaataactaccgtaaaatcgtacgtgaccagacattcgtagatcagaccgacaatctgtatcatttgaatctcccccaagactcaggatttgaaagtacggaaggcgcttatgacttaaaagagatgcaccgcatcgtcaacgcgctgccgaaggaatataaagtaccattttcaatgcacgtatccggttttaaataccgtgagatcgctgagaagctggacctacccctcggaacggtgaagagccgcatattcttcacacgccaacgtttgcaacaagagttgaaagattttgtataaatagggatagcacattagtcaaacaattaattctggtaaggagcaacgggtaaaaactcgcttgctcctttgattttgtgacaatatgatattaaacatgtctttataccccaacttattctctctgtatttgttattatgtcagagaactcagtatatttgtatcaactagttaacctaagtaatataaatctcatctatttacggcaatgaaaaaggaaatcaaattcagtctcgtttatcgggatatgtggcagtcgtccggcaagtatcaaccgcgtgccgatcagttagtaagaattgctccgttaattatcgaaatgggttgtttctcccgtgtagaaaccaacggaggcgcgttcgaacaagtcaacctactgtatggcgagaacccgaacaaagccgtccgggctttcacgaaacctttccacgaagccggcatacaaactcatatgctcgaccgtggtctgaatggtcttcgaatgtatcccgttccggcagatgtgcgccggttaatgtataaagtaaaacatgcgcagggagtggacatcacccgtatcttttgcggcttgaatgaagtcagaaatattattccttccattcattatgcccttgaagcggggatgattccgcaggcaacgttatgtattacgttctcgcccgtacataccgtagaatattataccgctatcgccgagcgtctgatagaggccggagcaccggaaatctgtctgaaagatatggcaggtgtcggtcgccccgaaatgctgggacgtctgacgaaagcaatcaaggaacggcatcccgaaatcatcatccagtatcacggacatagcggaccgggactttcgatggcttctatcctcgaagtttgtgagaatggcgcggatattattgatgttgcaatggagccgatttcgtgggggaaagttcatccggacgttatctctgtgcaggctatgctgaaagacgcgggatttcaggtaccggagattaatatgaaagcctacatgaaagcccgtgccatgacacaggagttcattgacgattttctgggttattttatggaccctaccaacaagcatatgtcttctttgctcttgaaatgcggacttcccggaggtatgatgggttctatgatggccgatctgaaaggagtgcattccggcatcaatctgatattgagaggtaagaacgaaccggaactgagcatcgacgatttgctcgtgatgctgtttgacgaagtggaatatgtgtggccgaaactcggctatcctccattagtgactccgttcagccaatatgtgaagaacgtggcattgatgaatgtgatgtctctgatcaagggagaggagcgttggacgatgatcgacaaccatacctgggatatgattctaggtaagagtggtcgtttgcccggtgcacttgctccggagattatcgcattggcaaaagaaaaaggatacgaatttacggacgaagacccgcagaagaactatccggatcaactggacgagtatcgtaaggaaatgacagaaaacagctgggatttcggacaggatgatgaagaacttttcgaactggcaatgcacgaccgccaatatcgggattataaatcgggtattgccaagaaacgtttcgaagatgatttgcagcgtgccaaagatgccgcattggcaaaacagggattctccgaagaagaagtgaaacggatgaaacgtgccaaagccgaaccggtgacggcaatggagaaagggcagatcatttgggagatcgatgtggaatcgccttctatgccgcccgaagtgggacataaatatggtccggacgatgtgttttgctatattgctactccttggcatacatatgataaggtgttggcgaattttagcggtcgtgtgatcgaggtatgtgccaagcagggagcattggtagataaaggcgaaccattggcgtatatcgagaggtgtgaggaaccggcatagtctgtatctcaaataataacagaaaaaagtaatccctttatccttgtcttgtttcttgatgaaatagactgtgataaagggattgctttatttctttttcttcttcctggtgtctttcttatcgaccgcctttttttctacaggcggaaacttaggaaccagattcattaatcgcaatatctgtttttgtcgtttcaataggtaagccgaaggctttgcagagttaaaccgtatcgggttagggagcgtagcggcaatcagtgcgcactgtcctgagctcaacttggcagctgttgtgttgaatttatactttgcggcagcctgtgcgccataaatcccttttcccatttcgatggagttgagatatacctccataatccgttctttcgaccagaacaactctatcagaaaggtgaaataaacttcgaaacctttgcgtatccaagatgattgcggccataggaacacattcttggctgtctgctgactgatggtacttgctccgcgcttccgtttccgtttttcgttctccttcatcgctttctctatctcgatgaagtcgaatccgttgtgttcggcaaagcggttgtcttcggaggcgatgaccgccatcggcaggtgaggagatattttatcaaaagaaacccacgtgtgtttccacgtgggtttatctcctgacgcaagctgctgtacacttcggatgaccatcagcggagtgacatacaccggcataaagcggtagacgatcacagccagaatggtagatgcaaagaagaaaatcagcaggttgcgcgcataacgcaatatttttttaattggaagcggcctgtgcatctttaatcatctgctcacttgcgtacatgtaaacttctacacgacgattctgttctcttccggcagctgtgtcgttgctggcgataggatcgctttcgcccattccctgcacacctttaatctggttggaagaaacgccgcagtttaacaggtagctggctacactctgtgcacgttcctgtgacaagttcagatttttctgacggctttgttcggcagtactgtttctccagccctgattgtcggtatatccgtagatggatacgtccatgtctctgttctggttgagtacgttgttggcgaacttgctcaatgcagacttggcagcagcactcagagttgcattaccggtagtgaaaagaatacctgaatcgaatgtaacttttactgcctgcaatccgttgttgtcagttatctgctctacttgtgcgccttcaatttgttttgcttctgctgccgctttatccatcttctttccgataagggcacctgttcctgcacctactgcagtaccgatagccgcaccgatggcagcacccttgcctttaccgataacaccgccgaggatagcacccaatgcagcacccgaaccaccgccgattgcggcacctttgcccgtattgttcatgcttgcgcagccactgaatatcatggttatactcatgaagagaaccatccatttcatcttgttcataatgcaatgttttttaaataggtttataaaataatactttaataaattaacaacgcaaagatacatattatttgccaaggtcatactttttaagttaaaataactccggacgatctttgtatatgtaaaataacaaacgacacgactaccttgttgacacggaaggcagatttaagcattttttcctgatcatggtgaaccatcccaagagaatcagtcctttggcaatcgttgtgacgcatactgcccaccagataccttctactcccatgcccatccgtacaaacaggatggcaagcggaatacgcatatagttgcatacaatgctgacaatggcaggaggcacggtacgcccgatgccgtagaacactccctgcattgtgatttcgagcatcataaacagctgcgaatatccgtcgatacgcagaaatacacctccggcttcgtaagccgcctgttcggggacaaagatcgaaaagacctcattgccgtaaaagacaaacagcagcgtgcagaacgttccgaagattcccgtcatccatagggtggtgtgccaggctttcagtacccgttctattcgtccggcggcgaagttctgggcaataaaggcgctgagtgcggtggagaaaccttgggaggtattccaggtgatggcttctatctgtccgccggtggtgaaagtcatcagcccgatgtgtccgccctgttcggatgcggtacggcagaggaacatattgacgaaggcgaacagtgtgtttagggtagctacgggcaggcctagtttcagaatacgccgcgtgtacttcttcttcagtcgggagaagaaggggaaaccgccgagcagggcgtctttgcggaaacgcagctgatagatgaagatggcgaaaaccgttgcctgcgagagccatgtagcgtaggcggcaccgtttgttcccagtccgaagccgaagataaacagagggtcgagaatgatattcataatcagtcccgtcccactgatgtaaaatggaattttgcttcgtcccgctgcattatagatacctgtgaaggcagcagacaggaatatgaacggcaatgcggtggaaataatccgcaggtattcgatggcattggctgtgatgtgctcttctagttcatagatgcggatgatggggcttgcgaacatgaaaagcagtccgccccagcagatcgaaatgatcagagcaatcgtgatattgtgtgaagcgaactggcgggcatcttcctgattctgcgcaccgatggattggcctacgctgacttcggaccctaccttatttaataaggagatagaaccggacatccacgtcaggattcctaccgaaccgatggcggctacagcctcactgcccaatcgtcctacccatgccatgtctgtaaggctgtatgccatctgtataaacgacgttgccatgataggcatcgccagattgaaaagttggcggttgatagggccgtgtgtcagattcttaattccttgcatatcattttttctatttaaaaggaggcgcaaagatacataaaattactatcttcgcacatcaaatattcattaatcaaagtatacagatactatgaaacagaaattctcttctctttttgtattgctggtcctgctattgacaggtctgcaagtctcggcacaaagtacgccaaaaccatttgatattgaacagccttctcttcgtgttttcctgccggcaccggaactggcgacaggtcgtgctgtggtagcctgtccgggtggaggatactccggtctggcggtcaatcacgaagggtatgattgggcgccgtatttcaacaaacaaggaattgcattgattgttctcaaataccggatgccgaaaggcgaccgcaccctcccgatctccgatgccgaagcagccatgaaaatggtacgtgacagcgctgacgtatggaatctgaatccgaatgatattggtatcatgggatcttctgccggaggccatctggcttcgaccatcgctacacatgcgcctgaagcacttcgtcccaacttccagattctcttttatccggtgatcacgatggacaaatctttcacccacatgggctctcatgacaatctgttgggtaaggacgcttctgccgatttggaaaaagaattctccaacgagaagcaagtgaccaaagagactccccgtgctttcattgtttatagcgatgatgacaaggtagttcctcctgccaacggagtcaactattatctggctttaaataagaaaggtgttccttccgttctccatatttatcctacaggcggacacggttggggaatccgtgaagatttcctctacaagagtgaaatgcagaacgaactgacttcttggttgcgtagtttcaaggctcctcgcaaagatgccgtccgtgtggcttgcatcggcaacagtattacgttcggagcaggaataaagaatcgcagccgtgacagctatccttccgtactggcccgtatgttgggcgacaattactgggtgaaaaatttcggagtgagcgcccgtaccatgttgaacaaaggagatcatccttatatgaacgaacctgcttataagaatgcgttagcttttaatcctaacatcgtcgttatcaaactcggaacaaacgacagcaaatcattcaactggaaatacaaagcagacttcatgaaagatgcgcagaacatgatcaacgctttcaagggccttccttcacagccgaagatttatctctgctatccttccaaagcttatcttacaggtgacggcatcaacgatgatattatctctaaagaaatcattccgatgatcaagaagctcgccaagaaaaacgacctgtctgttatagacctccatactgcgatggacggaatgcccgaactctttccggaccgtattcatccgaacgaaaagggagcgcaggtaatggcaaaagctgtctatcaatctatctctgctttaaaataaaaaatatgttaccgatcattgagcttttaaccggataattgtattgataatatagcccctgataaaagaaaggagaatattatgattagaacagttgctgtctttgtttttgtgtctttagcttgtgttgctactgccttttctcaaactatagaaaaggggaataaaatggatgtgcaaaagaaaaatagctctgcggaagtaagcggacaccagttgcccgaagcaaaaatcatagaaccgaagttaccggatatagaggctaaaaaacttgcaacagatgataagtccatgcagacatacggtctgacaccttcaagtcctgcatcgggcttatctccctatttttacgattttcctgcattgctggaaagtaatccggcattgacggatttttataattttcgtcagcattctatgaatggacagttttcttttattgggagtgcagaacaaaagacttatctgggattggggcaatatgtagcggtaaatgccggaatgcgctggattccttctcaaagatttttcgttgaagcgggaggaaccttaagccggcaattctatttggctttgcctatagcgagacaagacatagcaggaatatatacgagaattcattattctttagccagaaatgtccggttaaatgtctggggacaatattttatggggggaaatacaccccctccggtttacaatccgttatttccacatacaggggtaggagcttctatctcggtcgatgtgaaaacgaatacggaagtaagtgtcggtgcggaataccagtatgacaagaattcaagggaatggaaaatggaaacgtcaggccgtgtatccattggcttttgacacatatttcatcattcatttggttctgttatttatttcccatatctttgacgcattaaaattataatgtttcattaaaactagtggatgtttaactcatcatttattacatcggatttggtctgataagaatctgttcactttaacagattcgaactttcatactttcggataatctttccggaagtgattctcctatattatataactttagtttttatacccgcatacaatagcaaaagcattgttgtgctttcacgtgtatgctatatacattaagataatgagtaacgaaaataataatctgtcattatatggttggagtgataatctattccggcaaaaacaaatctcacaatttaaagatatgtctcatggacgaatcatcgtgacacataaaacctgttatgaagtagttgcagaggatggcgtatatttgtgtgagttaacaggaaatatgatttatggcagaatgcctgatgaatacccttgtacgggcgattgggtgatttttcagccatttgatgcaaataaagggattatagttgatacgttgcctcgtgaacgggcgttgtatcgcaagaagaacggaacggtagccgaccggcaggccattgcttcttacgtcgataaagcatttattgtgcaaagccttgatgataatttcaatgttcgcagagcggaacgtttcatagcccagataatggaagaaaatatcaaaccagtattggtgctcaataaagccgatttaggttgtgacaggcagaatatagatgaagcgatcaaacacattgcccgtcagtttcctgtatttatcacaagtatttgtcaacctcaaacgattctccggttgcgggaatccataacaaaaggcgaaacggtcgtgtttgtcggctcttcgggtgtcggcaagagttcactggtgaataccctttgcgggaaatcggtactgaatacttccgatataagcctgtctacagggaagggacggcatacttcgactcgtcgggaaatggtattggtggatggctcaggtgttttaatcgacactccgggtgttcgggaatttggtttggcgattgacaatcccgattcgcttgccgaaatgtttgaaatatccgactatgcggaatcatgccgtttcagcgattgtaagcatatcgacgagccgggttgtgctgttttagaagcggtacataatggtacgttagatcataaggtatatgagagttatctgaaactcaaacgagaagcatggcatttctccgcttccgaacatgaaaaacgtaagaaggagaaatcctttacgaaactcgtagaagaagtgaagaaacgcaaggctaatttctaaagaactattgaagcagggaatgccggtactttatcagacaaggtgatactgtatgacggcttctctgcttcttattgtttggtaagagtttacggcaactattctcttgcttttagagtaaaggcatttcaactcttgtgacatgttcctcttcgggtacatccggattgctgtaataatattctattgatgttcccgaagccttatatccatttgtttttatccattcggtcatctcattgtacagctgtgccagttcattgtaatttcctctatgcagacatacgactattcttctggcggggaggatgacagactgtattttttcgtcaccctgtaaaggtttcgaagatttcagtccgataatcatttctatacgatcttcggtcaggctttcaaagtcggggtattctacgaaggggatatccgtggttacttctccctgtttcttgaataaagagtctattcttacaaaattttctccgatagcctgtgacatacctttcatgttggtttgtacttcaatagccaaagcaggctgttccggctgctgtaaaagcatgatttctgatatctttgccatagattctgttttaatggtgattatttccgtatgaccggtatatatatttctgttagtaattccgacgtttccgtggtggacggatgattcatatacatctcaaagctgaatgtgctttggggatggtatttacttttcggaaaccattcctcataaatgctcctgtacactttgtgtaaagaagaatagctccccgtatgtctgaacacggcatatcgccctccgggaatttgcatgattcccggtaccggtctcgctttagtatcatcgcgaagggtgatgcccagatagaaccggcacttctccgtaggcgtaatcgacggatcgtccatgctaaggctgataaacttgtcatatcgtgggtctgcttcatactgttcggcatgatgcagtagtttattccaaagtaatctgtattttagtttgtttttatacgcttcacccacttcgatgcagaatatctttatcgggctgatcacttttatctccggttttatgtttgttgccggattttcaccgttcggtctgtgcttctctctgtattgagaagttgatataccaaaatgtttcttaaaagctttggcgatactgtatttagtctgataactcgtttgctctatgatttgctttagcgtatagtccgtagagatcagcagatgtgcaacgtgttccatgcgcaaacgctgtatgtaactgccgatattctctccggtagcggtgcggaacactcttctgaaatgaaatttggacagtccgctcatcgaactcagcgtgtcggtattcagtacctccgtcagatgaccgttgatgtacactattatgttctgaatcatcttatgatgaaggctgcttgtctcttgcttttgccgccatctgttcagtgtgggaaggcgtttgtccagtatctccctcagctctttcggagaatagtccgtgtctgcgtattcattatatttatctgtatattttatccagatgtcgatcatttcccacatggatatatcaacaatgtatttcccatccttcaggcagtaataacaaaactcatcactcctcgaaccgtcggagttggtgcctaaatattcctccacgtcgaagcggagcggcattccgcagctttggcaatatcttttatttatttctgattcaaccatttgactaatcttgcattctttgcaaaaataagctattttttcagtaaacagttgtccggaatagccatctttttattaacaaatgttcatttccgctatttcttaaagttgtatctttgctgcgcttttataatatataaggtaaagatggaaacaataactggaaaaagaagtttatcattctatgagccgattgtttggtgtaggtctgtttgtcatcaattcgatattggatatgttttgggctttatgtagagtcttatatttatgttctgtgtatattaataaaaaaacctctgataatcaatgattatcagaggtttttttactccgtgatccagctggggctcgaacccaggaccccaacattaaaagtgttgtgctctacctgctgagctactgaatcaatcctttatgctttctttcgaattgcgggtgcaaaggtagaacatttttttagaactccaaagcatttcaaacatttttcttatctttgtgccattatcaacaatatacaatcattaatatatggctgacgataaaaaaatcatcttctcaatggtgggagtgagcaaagctttccaaccaaataaaaatgtactgaaagacatttacctgtcgttcttctatggagcgaagattggtattatcggtctgaacggttccggtaaatctaccttattgaagattatcgcgggtctggagaaatcctatcagggagaagtggtcttctctccgggatattctgtgggctatttggcacaagaaccttatctggacgacacaaagacagtaaaagaagtagtaatggaaggtgtgcaaccgatcgttgacgcactggcagaatacgaagaaatcaatcagaaattcggtttgcccgagtattatgaagatcaggacaagatggatatacttttcgcccgtcagggagaattgcaagatatcatcgacgcaactgatgcatggaatctggacagtaaactggaacgtgcgatggatgcgctccgttgtccgcccgaagatcagccggtggtgaatctctccggaggtgaacgccgtcgtgtcgctctttgccgtttgttgttgcagaaaccggacatcctgttgctcgatgagcctaccaaccacttggatgctgaatctatcgactggctggaacaacatttgcaacagtacgaaggtacggttatcgccgtaactcacgaccgttacttcctcgaccacgttgccggatggattctcgaactcgaccgtggcgaaggtatcccttggaagggaaactactcatcctggctggaacagaagaccaaacggatggaaatggaagaaaagaccgccagcaagcgtcgtaaaacactggagcgtgagttggaatgggtacgcatggctccgaaagctcgtcaggcgaaaggaaaggcccgtcttaattcatacgacaagttgctgaatgaagacttgaaggagaaagaagagaagctggaaatctttatcccgaatggtccccgtctgggtaataaggtaatcgaggcaaaacacgtagcgaaggcatacggcgacaaactgctgttcgatgatctgaactttatgcttcctcctaacggtattgtcggtgtcatcggtcctaacggtgcaggaaaaacaactcttttccgtctgattatgggattggaaacggtagataaaggtgagtttgaagtaggagagaccgtaaaggtatcctatgtagaccagcagcataaagacattgacccgaacaagagcgtctatcaggtaatctccggtggtaatgatttgatccgtatgggtggacgtgatatcaatgcacgtgcgtacctgtcccgtttcaactttgccggtgccgatcaggaaaaactttgtggtgttctttccggtggtgaaagaaaccgtctgcatctggcgatcgctctgaaagaagaaggtaacgttctgctgctcgatgagccgaccaatgacattgacgtgaacacccttcgtgctttggaggaaggtttggaagactttgcagggtgtgcggtagtcatctctcacgaccgttggttccttgatcgtatctgtacgcatatcctcgcttttgaaggagactctaatgtattctactttgaaggttcctattcagaatatgaggaaaacaaattgaagcgtctaggcaatgaagagccgaagcgtgttcgttatagaaacctaatgactgactagtatttgctgacagattacaagttaaatctcacttaatatacgaaagtgaaaggctctgcaaacattgcagggcctttattgttttcgaaagcaataaaatgtttatctctcttaaaagaatgtagcataattgtcatctaagtctaaataatattaattatctttgtgcacagtttcaatgaaacaaacaattagtattaactaataaattacattatgttgaagagaatgcggtcttttttagtggtcgtaatgttactgattactgctacgatgagtgcgcaagttaccacagcaagtatgagtggtaaagtaacagcacaagatgaacctattattggagcaacgatcgttgctattcacgagccctccggtacccgctatggtacagtgaccaatgtcagtgggcaattcaatctgcaaggtatgcgtacaggcggtccttacaaagtcgaaatcacctatgtcggctatcagtcagccatttacaagggcatccagttgtcattaggagaaaactacgtattgaatgtttctttgaaagaaagttcagagttgttggatgaagtagtagtaacagcaccaaaaactatcgaaaaaataggtactgttactaatgtaagtgaacgtcagatgaacactttacctactattaacagaagtataacagatttcacaaagctctctccttatgcaggtggaagcagttcttttgcggggcgtgatggacgttataacaatataacgattgatggtgcttcgtttaataatagtttcggattaagttctaataatttacctggaggagattctcaacccatatctttagatgcaatcgatgagattactgtaaatgtctctccttacgatgttaaatattccaacttcacaggtgcttctattaatgctgtaacaaaaagtggaacaaactcattttcgggtactgcatatacctatcataaaccaagaggatttgcagggagctctattgacggtgaggatattcttaaagcaaaagaatacaactctcattcatatggtgtaacttttggaggtccaatcattaagaataagcttttcttcttcttgaatgctgaaattgaaaataaggaaactccgggggtaacttggcttcctaatcaagatcaaaatggaacaggggatagcggaaaacgtatctcacgtacttgggtgggtgatatgcgtactatcagtgactttgttaaaactaaatatgattatgaccccggacagtatgagaacttcaataatttccaaagtgataattggaagttaatggctcgtattgattggaatatacatcagaaccataagttgacagtgcgttttaattctgtttcctcagaagatgacagagaagtaagcgctaagtccactattataactagtactaattctaatcgttatggtttggatgccttttcttttggtaattcaaactataagatgaaaaacgtagtaacatcgataacaggcgagttaaatagtcgtttctcgaataatgttcagaataaactgttagccacatatactcatattagtgatacacgcgagcagaaaggctctgattttccttttgtcgatatatataaggacggaaagcaatatataactttaggtacagaagtgtttactcctaataatcaggttatcaataatgtatttagtcttgttgataatgtgagtatatcattaggaaaacatgaattgcttgctggcgtttcttttgagcgccaatattttaaaaattcttatttgagaggcccttacggatattatcgttatgattcaatggatgattttatgcagggaaaagtacctaccatttatggtattacatatgggtataatggtaatgatgctccaggttctgagttgacattcggaatggctggtgtgtatgcccaagacgtatggtctcttactcctaattttcgtttgacttatggcttacgtctggatatgccaatatatatgaattcattggattctaacaagtcaatagaggaattagcttttgtaaataatactcatgtcgatatttctaagtggccgaagacgcaagtcttgttttcgccaagagtcggttttaattgggatgtaaaaggtgatcgctccgtaattgtatcaggaggtacaggaatctttactggattgttaccttttgtatggttcactaatcaaccaagtaattcgggcttataccaaaatatggtagagtataatacacaaaaaaatccgggctctttacctgctgactttggttttaatcctaattatagagaaactctgcagaaatatcccagtttatttccttctacaccttcagagcaagcacctgatgttatagcatatgtagatcctaagtttaagatgccgcaagtttggcgtagtaatttgaatgtggatattcaactgccgtatgattttatgttatctgttggagcaatgtatacaagagatatttataatgttgcgcagatcaatatgaatgaggctgagcctacgggtgtgtataatgaacaaccggatcgtatttattgggcttcaaaaaaatacgagtataatgattatactaatggtaagaatgtagtagtaaaactttctaatggagaagataaaggatatcaatattcttttaatgctattttgacaaagaaatacgattttggttttacagggtctatcggctatacttatacaatggctaaagatctgactgcaaatcctgggtcagcacctaattcagcatggcaaaataatgtggcagtaaattcattgaatgatcctggagtatcttattctttattttctacgccccatcgtattattgctaatgcttcttatgaaattaattatgctaaatgcttaaagacaacgttctcgttattttattcaggatatcatacaggacgttattcctatacatattataatgatatgaatggtgatggcaattattcggatttaatatacgtgcctaactctcaggatgaaatgacctttgttgatattacagataaaagtggtgctattacttattctgctgtagatcaagctaaagatttttgggattttgtgaacaatgattcttatcttaaagatcgtaagggaaaatatgtggaacgtaatggatctttaacaccttggattaatcgctttgattttaaaattgctcaggatttttatgcaactttaggtgggcgtaaatatggaatacaggttagccttgatatgctgaatgtaggaaatatgattaattcaaaatggggagcatatcaatcttgtggtctcaagagttatgacaatgtacagttattaaaaactgctagcaaagttggtgaacccttgacttaccagataaatgctaattcacgtgaagcttttaaagaaagatcatcatggcaatataccaataccattggtagtgcatggtctatgcaattaggagtaaaagttactttctaatacaagttttaaagttaaaaagaaggattttattttaatgggaagccagttaattcataatgagttaactggcttttttgtagcctttctatatagtgatatacagcgtaaggtttataacctcattctcatcaccaccggattatgatcactatactccaaatccggagagaagtaatctaccccttgaaactcagacgaatggaggatatagtcgattctcagcagatgcttgaaatatcggaaagtgtacatatacccatgtccgcaggtctgaaaaccatcattcagtttttctccttttaccgtttgatatacatatgaagaagggagagagttgaagtcaccacataccagggtgggatagggagaagcggaaatcaattgattgatatgttcagcttgtgcggcacgtttcttgaagttctcgtgcagaccatcggcaagggtgagagcggcacgttccgcacggtcggtatcatccgcacgaagttctttttccagtttgcgcttgttgcggctgacttccgtagtctgcagatgattgttgaacagacggattgtttggtcgttaatgtcgatatcacaccacaggctgcagttgttggaatttgggtaggtgacgagctgcttctccttgatgggataacggctgaacacagccagttgcaaaagactctccccggcaggagaagaaggtacatagtaatacggccattcggaaagaacggtgcgaagactgtcaataccaaattcatgattgatcccaaactcttgaaaacagaagatatctacaccgagctgcttcatgtaagcagcgatttgcttgcatgagaaacctgtgtgctcgtgattaaagctgttaacgttataggtggcaatagtcagtgctgattcggtgtccctttcgtttttcttcagaaacgaagattcagtattcggttgggaagccgaatcaaaaagcgggaactggaggacacggggcagatacccccaatttcccagtatggcgattaaaggaatgaaaacccagcatcgccagcgaaccgtccaatagatggcagaggcgacattagccagcaaaagtatcggcagaaccaatccgataaagggcatcagcttaaagccctccggcgaagcatctccggcgaaggctccggctaatgtgaaacctgccagaatactcgtcagcaggatagacaggtagtaaagtaatctatataaggctttcattttatggtaaccatttattaatcatatccttgagcttcgcttgcgagatcggtttggcgatgaagtcgctgcatccggcatccgttgcagcgatctgatcctgttgataagcataagcactttgtgcgataatgggcacagtaggagagagctcacgaatgatcttcgtagcctccagaccgtcgagattaggcattttgatatccatcagaataaggtccggcttcgcttcatcgtatgaggtaacggcctccataccgtcccgtgcacgtataagcctgtactttcttccaagaatagctttcagcaaatcgaagttactgtcctcatcttccgctatcagaatagtccgctggcttggagaggcattggcggaaatactatcggaactattatcgtccgtatttccggaagtcttttcagaatcctccttgacagacgtttctgctggcgtctccgtagaagccgggtcaatcttcatcgaacccgtgccggtcggattttcatttgcattcccttcctgccgtttttcctccttcgtattttcggtcgattgatccgactcgtaaggtagggtgaatgtaaaagtcgtcccttgacctaccaccgaagaaacggagatttcacctcccagccgttcgataattgttttacagatagaaagtccgagccccgtcccctgcgcatagttgttcaacttggcaaaacgttcgaacacacgttctatcttctccggttcgatgcccgtaccggtatcagttacgtggaaaacgatctgattgcccaccagtttatatccgtaactgatgctgcccgccttcgtgaatttgaatgcgttacctatcagattcgagaacacttggaacacccggttcttgtcagtctctatcaccagtccgttttcggatggctcatagatcagttgtaccccttgcggcgtgcggaatacgtgggcgtcatgcacctctttacacaggctatggatatttaccggtgcgctggtgaactcgataatgcccgattcgatcttcgaaagatcaagaatttcgttgatcagttgcagcagacgttcgttgttggcttcgacgatctcataaaatgttttacgttcttccttattttcactttcggctatcagatgcgagaagccgacgatggcattcagaggtgtgcgtatttcatgactcatgttggcgaggaaagcagacttcagtttgtccgacatttcggctttctctttggatgtctgaagttcccgtttgatcttctccagttccgtgatgtcccattcgatgctgacgatgatgggggaggaaagttcgtctccgtccacccgtattttccgtttgtcgaggatgatctcgtttccgtttttgtctttcccttcggttgtccagtgcagtccccgtccggtggtggcaactagtgtatcttcctcccttttcttttctgccacttcggggggatagtagtcgaagtcattcttgccgatagattcgccgatgcacagattccggttgtacgattcccggttgcggtagatatatcggaaatcgttgttgatctccttgacgacaattccggcggggaggttgtcgatggtagtatccatgatcaggttgagccgtttgatttgcgcttcgtagtgcagtcgctcggatatgtcgtgggagaatgaccagtaactttcttcaccggagtcgttggtgacgttatacatgattccctcgtaagccagtatattcttgctgactttcgaaggatgatgggcgacgaaacttctgcttcctccgtgcaggatatccttgcagcgttcatgccagtcttcctgcgtgttcatatcgccggcgatttcatagattttcagtttgccgatctcctcactttccgggatgccgtggttgtggaggaactggcggttggcgaagatcagcgtaccgtcctctttggcggcgaagatgctctcctttgcgttgttgatggcgtgcgtcagcgtgttgatgtcgtttctgcgacgctgtatgtcggtgatgttctggatgtaaccttcgatgttgcagctgccgttcggtagttcgtctcgcagataagcctgaaggcgcatatagtaaatctctccggcgacacggacccgatagctgatactatcttcgttgagtccttcctcatttttccggcaccagttggtgaagctcaggcggtcttcttcgacgataaattcctgatatttctccagagagatgcttctggaagattcctcgcacaatactccggtgtagcccatgtaatagaagacattgtcgcgggtgttgtacatccactgtccgatctgagccactttctgtatctccctcagatttcggttcacctgttccagctggcgtttcacgttgcttcgctgggtgatgtcccgatattggcagagcaccatgtcatcgtaaggatacatgatacacttgaaataataggtattatcctccagttccagcttgtagttcttgctgatgcttcgctgttcccgaagcacggtctggaaggtgctgtaaaccttctcacgggtatgctcgggcatacgttcgaatatattttttcctaaaagcctctcttcttgtaaaaaccataaattgctatgaatatcaatatcaatgcaaatgccatttctatcgactaatagcatggtgtcggcggtcaacttcagtattctttgcgcattatctgcctcatgtaatgttctgttcatgcttgtccgattagatttataagattctgtttcatgcaaagatagcaaaatatttgattctctgttcttatttttcggcacgttttgctttttcccaggcgccgcttcctttttttcttttcagatagccgattcctttgagcacattcacgttcatgaataagaaataatagggaataaacagtactttattctttatttgtctggtagagaggtaatatccccagtatcccattccgtagaaaagaatctgtaaccccagcagggtgccataaaacaggggagattcgcccaatagcaaaacgactatattcagtggcaacagcgcaaacagcaggaatggagtgacagaccagcgcaatacccggtgcgacgtgtactgaaaactcaggattccgtaacggaaaggattcagcaacgggagcagacgccagatcgactgtaatcctccggcagcgatgcgcacttttcgtttttcctcttcacccatatctgccgatccgctttcgatggcgtaggcattggtgcagtaggcgatggtgtatcctttcatggcgatgcggagagagaggatgaagtcgtcgagcagcgtatccggttccatcggttcgaagagttcgcggcggacggcaaacagttctccggcagcgcctacagccgagtagaggcggaagtcgagcgctttcagtgtcgattcgtatttccagtagatgccttcgcctccggcggctgctccgtccttcgtctgtacggctatacgtttttctcctgccacgcagcccactttcgggttttgaaaagccagtacgatttcacggattgcctcgctgttgaccatcgtgttggcgtccgtaaagacgacaagcggggtccggacgagtgtcattcctcgtgtcatggcggctgtctttccctgccgtttcggctggaagtagacggttacttttccgttccagtgggtttggagacggtcgtttgtgccgtcatcgcttccgtccgtcacccagacgatgcggagtttgtccgcagggtagtccagggcgaggctgttctccatcttttcgtccaccacgtcttcttcgttgaaggcggtgatgaagagggttacttccggcagatcactgtccggtggcagcacccgtttcacgggtttcacgaaaagctctttcagcttgacgagggcgtagaggacgatgccgtagcccagataggtgtagaacaccatgaacagggcgaaccagaagatgatttcgaggatgagagtttcgttcatagctgtattctcgtttaatagatgtttgttgatttacttattgaagtcgttttttcagtgcctcttttttagccgattctttcagcatgtttacaaagtagagggcgtctgctttgttggaagcatcggaaggattggcctcgtatcgttttacgaaattctcggcgtgttcaaacaggtatttccgacagtcgatattgagcatgataccgtctttgtagtcagcataagatagtccggtcaatgcatcatttccttcgatagaaacaatgtcatacatgctaattcccgacaaattgatagtggtagaaggatagtagaagaacttttctcccggtaaatttactgttaatttgaaagaacttgcgtctatttgtgctatactaatatggctgtttaaacgataatagttatattcataatattcttcctggcttggaaaccataacgaatcatccccatctttaccataattactatttaaccataataaaaagtcgatccaattgttgtccgtaccatgaacacctatgcagattgctttacgttcttctttgggtaattttagcaggtcagtaatctgttgtttaaaatatgctggtgaatcgttaaactcccgttctatcagagatttttgtaaagtttcagacacttgatacggatatagggtaattgctcctgcttgtgcggtcatcgtttgaatttccggacattgaagagcagcagttacgtatgttttatttccattgggttcagcaagaaatttacatccccttcctgtgagtttctctacaataatgttttgggcaatatcaaaatgttccaatatttgtattggatcattagcatcttttgtcattacatcatggagggcaatgcctgttccatagttcaacatctctcgtatgttatcccatataagtccggatttcatataaaaacgataatagtttgcagtaaaccccggcagtacgtttgtttcagcatccatccatttttcttcaggggcaagagtggtagtaatagcaaaccgaacttcatttcctgctccgtctgtacatcccaaagattggttggcggaaataatagtagggggaagatcccctttttgcaaatgtttgatgtcaaaatataattgatgtttcatattctgatcagtgggagttggagtaggataaggtattgaacttgagatcggtttaccgtttattgcagcccacgtacggcaaaaagcagcctgcatgcagtcgtcttgtgttagcatcaacatccatgtcttattgtattttaaatgagggatttcgacattaatatctttggtctgtatttctttttttgtgtggataatgatttctgctgtaacgtttgctgtttctttgtcgaaaggatacatatagacgggagtagaatctgtatctttttcgttattgtcttgtcctgtatttctattctcatcgtatagattcatttttcttatacaggaagtataggtgaaaagacaagctgttactaagatgatatttactatatattttgccatatccataatgattttgatgagaccttatttgatgagattagagtctttatctttgtatgccgtctttttgataaagagtccggtgatttctttcagtgctttgattacccgtatccatatattatcaatcagtgatccttcagaatttagggttccattacttgtaagcactcgtgctttgcgacttgtaataaatacgatttttccatacggtttcatagctaatgctaacgaaccgtcttctccgcggataatatctgtacgaaatccaaaccgacgtcctatttccgtattaaaactgaaagccatacctcgcacacagagttcaggacgctggatggcttgtaagcggaggtatatatcgcgcaggccttcgtagcaccatagtccgaatcgggaatgtctttcgtcaaccataaaactccataaactgaatgtacatgcaaccttcggattcattagatattttacatgcgtttcaatgtaatgcggtggatataaagtatctgcatcaatacaaatatgatattttccttttgcatggtccaatccgcattggcgggcgtatcccggacctttcttcgtttcgttataataggtaactcccaatgattttaatacttcttccgttttatccgttgaattgttgttaacggctattatttcaatggggaaatggcaatgattctcggagagtgaccagatacaacttatcagatgacgttcctcattgtgtgcaatgagtacaaccgataccagtggagaatcgttttgacgttctttgagttgtcttttgactttgcggatactatcgtcagaaatctcatcaaaagatttcccgtatacttccagataagttttataccactttaccatatgttgttctgttatttagaagaataagttaatgattcgaataagtttttccattgtggcatcacattttccggcagaaagcgttttacgttttccctggctttgtgtcccatcttgatgcgtacattttcattctcaatcagatagcagattttgtctgcaagttccttgatattttctttctccactagtagaccgtcttcatggtcttttataatatccgaaggaccatgcggacagtcaaatgagacacagggtataccacatgacattgcttctgccaaaacgagtccaaaaccttcgtatcggcttgataagacaaatatcgaactcatacagtatttttcggctatattcgatacagtgtgatgaagcagacaattattatttagttgtagttcatctattagtttggtgaacttctctttcaggtcgccttctccataaatatgtagtttccagtccggatgtctttgggcgacaatgctccaggcggggattagcatatcaaatcctttttggggcgcatatcgccctacagcaatagcattatgtgacagaatatctgtttgttttccttctacaggagtagaaataggattagggatgatgctgatattagtcagttccggccagtctttagctccttcacttgtaagtataatcactctggacagtttagacaggtttttgacaaatctgtttgcccatcttttctttatcatgttgacaatcgggcttttacgtttcagtgcttctgcgccataggcgtagcggctgacgtgaaactctccgattttcaggctaccgtctttcaatttagtgataaagttcagttcccggcgcatggttgagatagtaatgtccggtttcagttcgttcaatagattcgatagtcgttgtttaaaccgatagtagcggaacggatacttcagcactttacttactatggattgagagtagggcaggtcgaaagatactcctaagtcgatatgctttactttgggggataatggaaagtgtggtgctttacccatttgttcggatgtaatgatggtgatgtcgtatccttcaaaatgttctgcaaaataattggctttgaatgtaactatccgttctattccgccaggtgcctgtagtgagggcaggtaataggctatcttcatgatttaatagattttagcaatgatttgtttccgataaaattctccggcgtcggacacttgttttccgttggcggcttcgtttacatattttcgttccagctttactttccgtttggctcccattcgccaccattcatattctacgtccacgtgccctgcgtcaattgcctgataaccggacttgaataaatcgtaagccagtacagtagccgtaggtcctaaagcaatcaggaagagagcggttttctcgagtttttgcgcttcattcagtatttcttcgtagcggtcaaatgcgtcacggggcggacaaagaatacgtctgatgctttttacattgtcaaagaggtcgttgcctacccccaaacggcttttttcgccttcaatgaatacgacatccctgtctttccagatagctttcatctggtgaaaccaccgtgggcagtcttctttggaagcgaagtccatgtagggacgggtgatgaatgtattgtagtatagcctgtcgggcaacagcaagcggtcccaccaactgccatacagaaagaagtgagttctccagaatcggcgtgctttgcggttatagcgataaatgttttcgaaagtatcggagatacaaaccaaatgtccttcttcatggcttgtcaatacttccttgagacgctgagccaagagtacatttcctttttggaatcctatttccttgtccgggttggtaagcagcatctcaccatcgccgaaacggctcacggaacattggtcttctacgattatccgaatggtctcatcaatggaagctacctgcggagttattttctgatggcatctgagagccatgtaccagaaattgtaccattctacagtaatgccataacgcaatttatagcggatagcattgatcagtggctgtatattcatagtgatatagttttattcaaaggtttcattaataacaatttgcatctgggctttccatgaaagtgattgctctatagacatccgtatttggagcggcgttgttttcaatgattgataaaagcgaattactttttcgatgtcaaggggcgaatcgtccggtgctgccttaagtatgtatggttgatgctcaaagtcatcatccgtttctgaataaacaaaaggaatgcctcttgctgcatattcacggttttttaaggtcttaattttgtcaataccgctacgatggcgagccagactgcctattcccatgtccgactgctcgaacacggcatccagttctttgccgtataaggcactatgaaagatgatatatttctctaactgatgtttggctacatcttttttatagctgtccaccagttcgggaaccccgaagcctacgatattgagatatactttataatcatgagtgtcggtatgtgtacgatagtaatttgccatgccggctataactctgtcgaaaccatgccatgggtgcattgtcgctacggcaatcagttgtagagaatgtgcggtatcattctttggacctcttaaagggatttcgctgaaatcaattccatttgagatgcggatggtggggcgattccaaataatgtcatagtccgaaaaagtgacgatcttgtcaacatagcgtgccagatgctgtcggaaacatttgtctataaataggattcgttggtatacgaatgggagtcccttatattcttggtcgtatggatatgtcgggatttccatcactatacgtgctccggtcttttttagtagtttcatcagccgtatgctgaaagggctggcattatggacatagcgtacatagataaagtctatgttttctttctgtacataatgtacgatactgtcaaattcgattctttttaggatttttcctttgatcccgaaaccatagtcggcgattatcgattcatctaccatacggcgtttatggttgtccgtatcgtctagccaacatgtatgcatttctagtccgcactcttggagggcttttacttgataacgtatctttttactgattccgttgaatgcttcgaaaccatggaatatgaggaataatcctttcattgtttgttcttttgtactaactttctatttcttgcaagagtcttcactttgcctgtgatatcataggtgtgtgttacttgcatatatgtcccaaagataataaaacttacgaaactttttgcaataagtgttacgaaaatattcatattttccatcatataatatataggcgtgaggaatgctgttattagtaggctgacaaggagtggagaaagaagttgtctgataaatatccatgcgtttctttggaatgtaactcgatacatcatccaatagcattgtacgaaattgatagtaaaagttatcacgatacatattgctacagctgtcagtgtgccgaaatagaatatccctgccagcattccgctcacattgagtatggacgaaaagagtccgcagacaaagaggctccttgtatcacctgctgcctgaaaaatagagcctgaagaagagagtatgatctgaataccgaccgaaagtgacagtatccggaatacaggaacagaaggcagccattgatcaccaaaaataatcagtgtcacttcttctgccgtaaagaaaagcagtacgctgagcggcagaccgatgaatgacagaaaacggacaatgcgttcataggatgttgccagcttttccttgtcattctggaaatcgctgaagatggggtgcatgaccggtgtgatgacttgcgtaatattttgcagagggagcatcatcaagcggtaggacttttcatagtatcctaaatcagacatactcatatatttaccaatcagcagtttatccagattgcggctgaagtagttaatcacgttaaacaagaattgataggccgaataggagaatatctttcggagtactttcagtcctagcgtgaaacgcagccgttgcggatagcgttgataggaaataacgaatatcagtatgctggaaagtataggattgatgatcagcgcatataagccggctccgcaaagcgcggcagttattgctccggcacctccggctatctggatgataaagcttcggacagcaataaacttgaactctttgttgcggtagaacaaggctcccggcacgatgttggcagaggcgaagaacaggttgacggacaggagctggcacaacgtccgtaagatcccactttcgtagtaatcggcgatcagccaggaagcggcaaaaaagagtatactgattccgatgcctgtccatacggtgaatgagaagatgtccgatagttcttctttagtcaatgatttatgttgtacgatagcaggcgatattcccatatccgtaaagagattgaaaaatgcaataatgaccgtagcgattgccactactccgaagtcatccggagagagcaaccgcgcaagaatccctgccacgacgagtgatataatgattccgctgtatttggctagtgccgtgtagaaaactccggaaaataactgatgtttaatattgtttgccattgcctgaatgattcttttctgatctacttgtgaatgatggatttgaataacaagactccgatgcttcttatagatataagttttttgtatctaaacagacaccgccacgccagccgaagccgatatgggtaaggaagcacatgggcttgccaaatgacagcattcagcatttgcgacagatataaatcaatagtatctttgattttgttttcagaggtttgttgcttgaatttgactatctcttgagtaacagtgagatatccttttaaatttttgagtgaaaaatcgcatgtcataattgaatttttacgtatgcgccggtgaaagaacgatcgttggatacagcttgttcttcgggcttgcagataaagtaaggtcgtgaatagctgatcttcgtgtacaatatccggataaaagaggagctgtcgttcttccaaaaaagctgtgcggataacgttcaggcaggcggatggggtgtacgttttgtgctgcaattgtatgttgattgcttcgggacctgtataaaccttgttttctaacttatcggtacgttgataatttagtacgggagcattgcgaatatcctcttcaaaaaagctctgagcatcaaagaaaacgaaatccagttctttttcttcgcatttgctgtagcacagttccattgcatccttttccaacagatcatcactatccatgaaatagatgtatcttccgtgggcatgcgtgatgccggcattgcgtgccattgacaatccctgattgctttgcgaatacacctgtatccgactgtctgccgcagccagttcttctacaacttgcagactgttatctgtggagccgtcattgatgatgatgatttccaattcccgcagtgtctgattcataatgctttctactgcctcccgaacatatttttcggtgttatagacaggtatgacgacactgacttttatttcttcattttccataaatactgtgtatggctactctattgttgtttgtttttgagatcgtttaaagagagagattggctaggtttctgtaaagctccgcatattcttttcctatttttccgctgttcatgttttcaatggcatacgcatagttgtcttctcccttccttcgggcggacagttggcgggctgtctccagtgctcgtatgatatcaaatttgttgtcggggtggaagacggggttgcccgtatcttggaggatttctcctatattcccgatattggggcctatgaccactttgtgaaaaaggaaggcgagaggtatactggcagagttcagaatatcttttcgttggatgaatattacatccgaagcggccatgtagtaaggcaggtcgcagttgtctataggttcgtcgctagctccggcgtgcattctgcgcaggcggttgagcaagggtataagcaggtaatatcctgcccgggatgcccagcgcttgaagaagttgctgccatacctgttgaatctcgaaaacgggtacagccgtggagcaagcaggaacttctttgcttcatcccattttcggaacgctccggtcaccatccgcctctcttcacgattccggaactttccgaacgacgtgacgataaacgcctcctgcggcagattaagatactggcgcgcacgttccacgctgatgtcctccttgtatgtgtactgataaataggatgaggaatgatgacattccggctgtccgcgtgtttggctgcaaattcgtcgagactgtaacgtcccatgtgcaccaccacatcgctttgttcttcgataatgtcataagcacggccgatcacctcgttcgcatcatgcggacggacattgtggcgcgtatacacgaaccgggccccacgggaccggaaaaaagcgatacactccttcaggcggcaaatcctgtccggatcgtcacaattcccttccatcacctcttcgggccattggaagtggatgatgtcgtaaggtgtatccgagttccagaactcattcgtggaacatcgtacgtcaatccccgtcgtcctgatagcatcgcataaaatggggacaaaaagattgtccgtatctccattctctctgaaaacgattaatgcttttatcggtggattgcctatttcattgtcgttcatgcttgattctttgtttttggtgggcttttgccacatacaaaggtaataaaagatatgatacttttcatcttttttgctttttttcggtgttgtgcctttattccttgtgcgtccgctttatctctctgttactctattagttgtcaagcgtgttcatatctatgagaaacaggctcctgtcgaaggggatatgccgcttatggaggtacttctgatagtggtagcatatcgttatgaaactttgtacgctgcatttggtcacttcgttttcgtaccggctcagggtggaaatactgagattggtcacatctgccgcctcttcaaggttcagattacataggtggcgcaaatggatgattcgttctatttgtgcatgacagttcgcttcaatacgcagccggtcgtaaatttcttccttggtcgctctttcgtatcctttcataattttttctttttactaattatgccgcaaagttcatagaaaaatgtcaaacatcgtttgcagttctgcaagtagtttttcaaaaaagtattcggacctttgcagaacgaattcgggacatcctgaatcacagtcaattaattgtaagatatgaagaaagatcagtattttaatttagaggtaaattttttgagtaatgacaatattgtcagaatgatgatggaacttgacgctgcgcaatcgctcggaatctatatgatgcttcttacgcatttgcgtaaagcggacaattatgaagcatcttgttgtccgctttgtatgggggctttcgcgcggatgtatgacttggatgccgatgtgttgcaaagggttctccgtgagttcgacctttttgtgcttgatgaagaacggcaaatgttccgttcgccttatctggacagggtgatggcaaagctcgaagaaaggcggatgattaatgtggcaaacggcaaaaaaggaggtcgtccgaaacgcatgggaagcacaccggaaacaccgatggataaaggcgaaaaaccgaatcaaaaccagaagagtagagaagaggagagaagagttactactgttgtcaaagacaacaacagtagtaacgaagaaaagacagagaaagagcactctgccgccgccgcttctgacggacttcagattgttcctccaccggaggataggggacagttgcccctacagccggttcttccgtgggagatgctggtggatcagatggccgaatcggaaagttacatggagtcgatggctatgcactcctgtatgggcaaacttttcgtggaacggcaggaggaggtgatcgctgcttttaaagagcatatccgacgctttggcagggaagatggcttgctgtttttgagggatgtgaaactgtatttcggcaattacctctctccgggcggacgtccggctcaggagctgaagaaaaggctgctcggcagttgccggcaagcagctgaggaagaactgtatcgctttgaacaactcattggcgggcaacggacgtatcttgggcatccgattccgaaggatgcgcctccaagaccggacaggtctgccgtgtgggatgaagtgcattggaagtggggaaattagctccggatttctccgacatccggctacgtgagcgttgcctttcagctcggtgctcgttcatgcttggctcggtgctcgttcatgctcggctcgctgcttatcggtgttcagctcgctgcccatcggtgtttagctcggtacccattgatgcttagctttccgcctgcattgggaactgatagaaaaattattaactgaagtttcgcaagttctttataatattgacaaacaatagtatctcaattggggttgactaaaaagtcggttctaccttaattctcctccttcctgaaggaggagaattaagatagttttgataacgcaaaggtaacctgcgaaacttgaattattaatacaacttaaaatctccttttcgaaagggaggaatagaaatacagaaatatgagaaattttgctaattatcatgtcgatgtccgcagacacaccagcggtgtcgttaaaaccatttgcgagcaatgcctcccgacgaggcacaacaagcgtgaccgttcgctgcgggtcaatatcgacacggggcattgccattgctaccattgcggagccgacttctacgtccccgacgatgccgaagagcgtgagaaagccgagcgacaggctgcccgtaaacgtcgtgcggcatctgccgttccccagcatttccaccgtccggtgttcgacgcttcgaagacgacgctttccgaagctacggagcgttggctggtagagacgcgttgcattccgcagtccgtcatcgccggtctgcgcatcacggagcaggaagagttcatgtcgcaatccggcgcgaaagagcggtgcgtctgtttcaactattttgaggacgggaaactcgtcaacaccaaattccgtagcggtgccaaaaatttcaagatggtgcagggagccgaactgattccctacaatatcgattccgtgctgggacaggacacctgtatcatccacgaaggcgaactggatgccgcgtcctcccttgccgccggattcaaaagcgtgatctccgtacctgccggagcaaatgcgaacctttcgtggctcgaccgcttcatggagtcgcacttcgagaatctgaaagacatcatcatagccgttgacactgactctgccgggctcaaactgcgtgacgaactggtcaaccgtttgggtgccgaacgttgccgtgtggccgtctacggaccgggctgcaaggatgccaatgaacatcttgtcaaatatgggatcgacagccttcgtatcgccatcgagcaggcggaagaaatccctcttgaaggcatcttcaccgccgccgatctgcacgaagacctgcgggcattgttcgacaacggcttcggtcccggagcggagacaggctgggaggagatggataagatttgtacgtacgaacgtaggcggctggtcatcgttacgggcataccgggggccggaaaatcggaatggctggacgaactggtgttgcgcctctgtatgcgccatcagtggaagatagcgtttttcagtccggagaataatcctatcgtctaccatctccgcaagttgatcgagaaactgaccggacgccgttttcaaaacggttgcggcatgacggaaggacttctgctccgttcggaagagtttcttgccgaaaacgtctgtcacatcgccctcaaaggcagcgccactccggaacgggtgcttgccaaagcccgtgaacttgtcctgcgtcggggatgccgcatcttcgtcttcgacccggtcaaccgtttcgagcatacccccgcgccggggcaatcggaaacgcagtatctttccaattttctgaatctgtttacggagtttgccacgcaatataactgtctggtgattcttgtggcgcacccccgaaagatgaaccgcaatccggtgacaaaccatactccgcgtccggatatgtacgacgtaaacgggtctgccgatttcttcaacaaggcggattatggcttggtagtggagcgtgacaaggaggtcggagtgacacgtgtctatgtcgaaaaagtgaagttcaaacaccttggagcaggtggtgtggctacttttgtctacgatcccgtcagcggacgttacctcccctgcgaagagtcccaagacccgtccgtcccaccggaacaacgggtcagaaatactgtcaatgacagctcgtgctggttgccggagaaggagctgtttgaataggtaataggtaataagtattaggtattaagtattaagtattaggtaataagtaataggtaataatcgtagttggtgagggtggtgggtaacaggtcacgggggatgagtaacggtgcggatcactggttgaatggtgattcattttgataccggtttactttattttcgcacagttttgaggtaaatacggattcatgaaacgtcatccgatagaatgattatatttgcatttcgattctaagaaacaaataataaaccattaatctgtaaacaatgagatttagtaacgtaagattattagtaaaggacttcgccggatgcttcaaattctataccgaacaactcggattagagccagcctggggagatgagaatagcggatacgccagttttaaagtagccgacggaatagaaggtctcgccctttttgtatccgactggatggcgccttcggcaggtaatgcagataagcagcagcctgttgggatgcgtgaaaaattaatgatctcattcagtgtggataacgtggacgaaacctttgtcgcactgaaagcaaaaggcgtgacatttatcagtgagcctacggatatgcccgattgggggatgcgtaccctgtacctgcgcgatcccgaagaaaatcttatagaactctttacccctttggcaccggagaaatttagccaggaacttatcgaagaagatcagaaatttcattaagagacacggctgaaaagcaacgtgttcatccgagtgaaccggaaaatgatattgaatggggctgtccgaaaagagaacgtctgctatcgttttgctctgtcatcctaagtctgccgaagaatcagctctttatattagtcaaagaagagattcttctccgtgtgctgaatgataggttgatagtatttatctacttttcggacagctttatacgttaatcgggtatcttgtccggaactattcttattttgttttaactgctgattggcaccaatacttaatacttatcttcaaggttcttgcagcacctctacgatcagtcgtacttgtgcgggtgtgtagtgtctgcttcggggattcatgccggtggatagcaggcgttcttttagtccgggtgcggcttcgatccattcgttgaagcggtctactgcgctttgttgctggacgttggggatatatagcatggcgagttctccttttccgtagctgcggtattggaaggatttttcttcttcctgtttttgcagggtatctgtatttgctttcatttttgatttaattgtagggtttgtaatgggtataaagttactgttttttactggatttagcaaatttgttgctcatgaaagtgttgcttttatgcttgtattatttagttgttattcacgttgtctgcttgtctttttggggggtgtttattcggggttggttgggagctttttcagcttttatctgctttatggttactttgtattcgcttttagtatgctttcaatctgtttctaattcactttattctgctttatgctgtcttaatccgtctttatccgttttatcccgtcatagtccggtgcagtccgttgtaatccgggaaatcgccgatgcactgccgtatctttgtttcaccaacagaaagggagaatgtccttcttttctttaatacaaattcagtatggcaacagtgtctgtggtgcgctatcagcgcaaaaaaaagattggtgatgacaaatcgccgatggtgtatgtgctcaaacccaagccgggggaatcgaaactttattctatcgagtcgctggcgcgtgagatcgagtcgatcggttcgctttcggtggaggatgtggagcacgtgatgcaatcctttgtccgttcgatgaagaaggtgctcgtagcggggaataaggtaaaagttgatggcttggggattttctataccacgcttacttgtcccggtgtggaactggaaaaggactgtacggtgaggaatatcactcgtgtcaaccttcgtttcaaggtcgataatgctctgcggcttgccaacgacagtacggcaaccacacgtggcggggacaataacatggtcttcgaacttgtctccaagaatgcgccggcttcgggaggcaacggtgatggcggaggctccggtagtggcggtggcagcggttccggttccggtggcgatggaggggaggaggaagctcccgatcctaccgtttagtccggtaagtacatcagcatcattaatgtgtgatacctgtaaatgaataacctgtaaaaatgaaaagttatgattgacaagattttggagattgcattggaaatcctgtttttcttccgtaggaagagaaaaggaaaacgaacgaaagggcaggtcgatgaggaagattgacctgattgtgatccactgttccgcctctagggtggacagggatttcacggaaacagaccttgaagtgtgccaccgccggcggggatttaacgggattggttaccacttttatatccggaaaaatggcgacatcaagactacccgccccattgaacggataggagctcatgcgaaaggattcaaccggacaagtatcggcatttgctatgagggcggacttgactgtcacgggcggcctgccgatacccgtaccgaatggcaggtacactcgatgcatgtgcttgtgcttacgttgctgcgtgattatcccggttgccgggtgtgcgggcatcgtgatctgagccctgatctgaacgggaacggggagatcgagccggaggaatgggtgaaggcttgtccgtgctttgatgcggaggaggagtgggcttgacgaaacttgctaatgaatatggttcaggcacggttttcatagggaaattttaggcacggatgatacggacgccaacacggatttgagaggctgcgcagccaaatccgtgttaattcgtgtcatctgtgccttttcttttctttcacggtgaggctttattcttctccgtgctcggtatgaataaactttttgttcgctcctttcagtcggaacatattggctatcattgccagtgccagtgtcggaatctgcaggattgcttttcctaatttccggttcagcaactttcccggcacaggtatgatcatggcggcaacttgagcggctgacagtatccaccatttgatggctgtataccattcgtatcctccgctttgcagactcattagtaagccgattgcggtaaagagtaaagtgaaaccgaaaactcccgccagttgtatcagacggggaggcagcatccattgaagaatcttgtcgcagtagtcgatatttccctgaatcagtgctttcgggaaatcgggcaaggaagcccgcaatgcaccgtattgtgctgcaatccatcgtttacgctgatttttgataccttcttttttctgtgttttttcatcgtatacaggcagttgttccagatattcgatatgaatgcgttgttttagcaacagggcttccagctccttgtcttcgcccgatgtttgcagatgtcctacatttcggcggaaccaatgaacgtcgaatgccattccggaaccggctaatccggctgacaatcctatcgcgttgtgcccgctacggaagaatccgttgtttatttcttcgctgatcgcatccagaacagcgatgtctgtattcatgttttttcctgtgcggtgggcttgtacggcatgcaggccggactcaaaagcacggttgatttctgcgaggaaattgggagtcgttacattgtcggcatccatgatcactactacgtcataagattcgttggcagtgacgttcattgccagcgtaagggctttggctttggaactattggtatagtcggctacttgcaaacagatggggagtgtttgtagggcagcattcgtgtccggctgcatctgatcggagatgacaagaacgtcgtacatttctttggggtattcctgttcgaggaaattacggatagtggagacgatcaccctgtcttccttgtatgcagggaagagtacaagaaaacgacgcaggatacgtgcttcggaaagttttcgcggacgatagaatttggaggcaatggcgtagaacagcagataaccgacacaaagtgccagaagaataaagagaatccagtcaataaaggtgtacatggtctttcatttttaagggttatcggataggagaggtgacagaaaagcttctgacaacgcctttccatactgcggcaaataaatcgaaacgacctttcacggcaaactgaaggctattttttccggcagctatggtagattgataaagaatggagagcagccgttgagcacctttccggttgcggcgggtgtagagcaaacggttgcgcgtcatgtagaaggtacgtagcttgctgaactgtccggtgctctggctttctttgtggaagacggtgcaacgaggctcataccatagttcgtaaccggcatttgtcatctgtgtacaccagtccatttcttcataatacaggaagaatatttccggcatttctcctactttctcaatgacttcacgttttaccatgagtgccgccccatgcaggtagggggtcgtgtgcggggtgtcgaacgtgccgtcgtccggacagccgaaacctgtcatttcgttgcgtatagtgattgccgacaggggggtgaatccggcaaactgtatgttttgcggaggaaaggcaaagcgtatcttcggagagacggctccgatgtttttctgactttccagtcgctctgtcaggtagtggaatccgtctgattcaacataagtgtcattgtttatcagaaagatataggctcctttagctactctgatccccagattatttccaccggagaagcctaggttcgacccgctccgcagggtgattatatcggaatatagctccttgattttagccgcttcgtcttcgcgcgaagcattgtctacgacgatgatttcatagctcacggaatgtacatgtgtttgcagcgattctattaattcgcaagtgtctttaaagccgttgtagcaaactgtgataaaggagacttgaggttcgttcatcataatctattgttcgtttttcagttctgtttctttactttgctgcatccgtttgtcgatgtatggtcctgcgaagcagagggcgaaggccgtatatatggggatggagttgggatattgcattacgtcgttggcataggctgccagatagaatccggcagcggtacagagccaggcagtaagtaagcctcgcaggcgtttgttcatgatcttgaacatcagtatccatccgcaccatgcaaaaaggactccgtgaacagccaagtagagaactagaccgatgattccggtttctacccatactgagactaaccaggaatccggtggatagggcatacgttctttgggatagaaacggtcgcctttggataaccctatcccatatccaaaaggcttgtggatcatcaattctctcattttctttcgattgtctacacgtaattgataggaagcgtcttggctaggacgaaatgcggaacgcattttgcggatatattgattgtcatctcctatattggtacatacaaaaaacaagaataacaaggcaagaactgaaagacctgtaatacatgctttgcgattgcgtgaaagaataatgaaactccctaaagcaccgataggcagagctatcgcagcgcgtgtaccagaaattcccattccataaatggcggcaataatgacaattataaaatagattttcagccatacaccttttatataaaaaagtgaaattccaaagagtgaaacacccatagccatgtgtacaccgaagtttgctgcgtcactgaagaatgagaaataacgaataccggaccaaataatatgagttcttgctcctcccaaaacgtatagaaagtactgctcacgttcattaaaaccatagtttttttgccaatatcctttggctgctgccaagaggataaaaagagaccatataattagaagccactgaatccccttaatgttacggattgctaacggtacgatgacagcacatacaataggatatatgagataatgggtgatggagatattccatgctgcctgaacattgttcggattagctatctctaatatgcaataaactccccatatcagaaaaagcataagcataccattacgactttccgaccagtcaattttttcatgcattccgtacgcaaaaagcaaaacaactacaaacaatgtacacattaatgttgctactcctaatggtatgtctgtcactgcataagctgctgccagcagaaattggagagtgaaaagtgtatagaaactttgttttgaatatttgataatcaataagaaaatagctgtcattaaaggcaatgaactaatcgtcagaaagaaaggaagggaggtacgaaagaacattttgtataatatatacaatcctcctgccaatagtaaatgtacccatcctttattggcaaaatagctaccggctactgttaggtattgactgtattttcctttatcattcgtcatcttcatctcctgctgttgccggctgcttctttctttttgtgaacgtaaatatactttctgtcaatgctaattgtgacagtcggtaaactattttcctccaaagtgtaaatggtggaagcataccagtgtagtcttcaaccacattgcgggatgcatgtgtcaagtaaacataaagtggagttttacctacttgttgacttagcttttctgacaaaagcttatctgtctctttccaaccacggtcagcacgggctacgagtatatttagattagcttcttgtagtaattccagcgatatgctagcttctcgcaggttgggatattcaacgatgagaatatcttcttcctccgatgtgtatagatcggtaatgcttttggccagattgtattctcgtgaatcaattctgaagtctgacttccatgttattacttttgttttaagtccgatactgttccagtatttttttagggcttcgatcacataacttttgccttccccgccttctgtgctaataaaattgataatgtagggcaatccttctttcttttgctgacagaaacgaaggatactattgcttaactgttttgtagctatactttttgattcttcaacatgattgtgatactctaaaatagagtcttttggaaaggcgcctaacatcggaagcccaatcaaacgacgtgtacgaatagaatcgcgtagagtacggtctaataattcaagaattaagaagaatcccaaaataaataagaaggtaccggcacacgctgccatcaccatttttttcaaaggagtgggcatggcactgatcggatatgccggagcattcaacacttttaatgcagcggaggtcatttccaaattttttctacgcatgagggcatcattgtagcttttcaatacagacaagtaattttgctctataaaagttatgttacgctcttgacgtttgatagtggaacctactggtgcaaactgtctgtatttctcgttgaggtctatacggctttgctgtataatttgtaagtctgatttggctttttcgtattgcatggttacttcaagccactgttctatgatgttctctttagctattccttctttggtatatttgttctctacatatttgtttgaaagctcggaaagctccttgcgcgtttgatttaagcgattcttatattcctgtaatgaggcttcttgattctgatgatcacttgaaatcgtttccatttctgagatttttcctgtaagcgaagcggcttcatttagtttatccaagaactgaagattgttgattacatgtttggcattgctgcccatttgcttttccagttcgtttaacattgctttggcgctgttgtatgcaatcagtacgttttgttcacgtaactcaaactctttgttgatggcagcgatttctttggtctcatcgtaataattaataacacgtttttctacgttatattgcgttagtgagtcttctttaagccgaagttcctttccgatgcgttgaagttcgcttttaaaatattcgataactttatctgtttcaccataacggattgcactgtattcgtttacaaattctttggtcagaatgtcaatggtattataggcgatacccggatcacttgccgtataacttatttcaatcagatcgctggcacctttacgcgctactctgattgctctgagatcattataagagtaatagggcaaattataatagaatactccatagagatagtttgcttgagtcggtctcaagtaattgaaaaagttggctaccgttttatcttcgctgtttttatctattaatgacagtatttctttcccgttcggactattctttaggtgttcatatattctgttgtaattgctggctttgatgaattcattgtcttcttttggattacctttgatcagacttcgggcatataatcgcatagatacccgtttgagtgtactttcagccttgataatgttcattaggttatccatagcgttctgagttgtcgcccaatccactttgttatttccaccttctagattgtagccggaagcagcaccagtgtagagggttgcctctacattatatgttttgcctatcatgcgttttccaaaatagtaaacagcaaatgttataatggctgttccaattactaaccaccaacggatacgatataggaatctgctgatataaaggatgtattccataaatgtatgtttatttgtttcttaaaatgggagtgtgggtgattaactcaagtatcattaaactcttgcttagttcgaatttgctgttttcgaatttctcttgtgcgtcagattggcgagacttttcagatgataaagtccccgagtcaatagctccattcgagaaatccttttcagctatactatattgtacattagcaagcatgagggcttcggcattaagtttaagaatgtttaattgggaggtcgcagttgcgtatagaaggataatttcctttttcatttcctcaaacttaacttctctttcaagttgggcggtacgtacattcagtttttggcgttttacccgcgctgtcaagtcaaagagaccgtccaaaggaatgttgactcctgcacctactgtatatccgttctgtgcctgtgttgcataggtcaggtaaggtgcaattgctacatctgtataagtagactcgttaccgaacataccatactggtagctgccccgtaaactgaaaaagcctaagaaggcacgcttctcttttgccagaagcttccgttcaatttgttcttttactgtagctaattcataggtcggagcgctttttgcgttctcgaaaagaagatccagcggtggaagtgtaatgctggaataatcacttggttgtagttttgagtaatcgcttacctcttgcgcagttacgcttccagtggaggcaaacaaaaatagtaatcctccgaagaggtatctgatttgtttcataaattaaccctattatctgcttttgctgtgttatagcaacgcaaatataaggattaattttatttaatgatgttcttatggaagcattttatcatctttcttgttaattatgagcaaatacttgtttagaatgcctccgtcatgttgaaatagaataaattctgcttgttcaccatgtctctgccgaagtcaagacggacgttcatacggggctgaacttcaatgcgtaaaccgagtcccagattaggaagtacaccttcgattttgcccggagtagggcccatgaagccgcatcctccccatgctacgtagcctacatgattcagcatcttcttcacccaattgcttttgtccgtatttatcatctgacggtattctgccatcatcacgtgggatgacttgtcgcgaaactgtcccatataataaccacgaaggtcgaaaggagtgccgctgagtgcgtatttagtcaatggaacattgccgaatacattctttgtttgcactgtccaagccaatactttacgtttgcctagggtcttgtattggcggtagtctatttccaaacggtagaaattattatcgcttccgaaggctttgttgtacatcatcccacgaaagtccagatacgttccccgataagcattggcgggaacgtcacgggtgtcgtacgtcagcaggaaaccgactccggaactgaggttagagtagccgtgatccgtaccgccggcagcaatatacgatggttgctctatcattcctgcggcaggtttagtgatcttgtcataattgaagtcgatctgcgggccggcaaagaagttgcttttccccagacggaataaaaaccacggattcacctgcacaccgctataacggtattcgctggtgtcttcgccacgcggatagtccttgttggtgctgtatccgatgccgtagaaattttccagtgtattcttatatgcaaagactccgaagatgcggaatcggtcgcctttgaagaaaagctgcggtttggtgaacaggttcagtcctccttcgaacatcagggcgatggccatcggcaccaccgaacgttgttgggtagtatcactcggattcatccgaaacgtcatcaatgcactaccgccgatcagtaatccgaagtccggagtatagctggggccacctaatatattatagtgtagattacgtttggctacacgctgacgtcgcaattcttttttggaaagggtgggggtggaatctgccggggctaccccgacttcgtcaacagaagttgtagtcgtttgcagttcatcgctttttactgccgtgtcagccgtttgagctaacgaaatattgatgaatagaaacatcatcaatatacctattgtatatcttttcatattctttcttgaaatccgctgcaaaggaaactattttatttcgattagttttcattctcatagataataaatctaaaaaagaatcgtatttttgccaattaataatatgtaaaacgaaattgccaacggattactattagcatacaggcaaagttaatttataaacgatctataatgaataaacgaattttatcagtttttgtttgctgtgccctttactattctgcacaggcacaggacgcgaaaggcggcatcagcactgacatgatgcagcaaatcaaacagagttatcaaggtacttctaccgacaaggctatccggaacgccatcagcaacaacgacatccgcaagcttgccctgaaccaggacaacatgaaggggatggatacacatttttctgtcaaagtgaactccaaggggatcaccgaccagaaatcgtccggacgctgctggctcttcaccggtctgaacgtaatgcgtgccaaagccatcgataaatacaatctggggtctttcgaattctcgcaaacctatcctttctttttcgaccagctggaaaaggccaaccttttcctccaaggagtcatcgataccagcgacaagcctatgaacgataaaatggtggaatggctgttccgcaatccgttgagcgacggcggcacattcaccggagtagcggacatcgtaagcaaatacggtctcgtccccaaagacgtgatgcccgaaacgaacagcagcgaaaacacagcccgcatggcgagtctgatcgctctgaaacttcgcgaacagggtttgcagctccgtgacatggcctcgaaaaaagccaaacctaccgctatagagaacgctaaagtggaaatgttgagcaccatttaccgtatgcttgtcctgaacttgggcgtacctcccacagaatttacctggacgcaatataatgtcaaaggcgagcctgtagaaaccgccacctacaccccgctttctttcctgaagaaatacggtgacgaaaagctgattgacaactacgtcatgctcatgaacgatcccagccgcgaatactacaaatgttatgaaatagactacgaccgccaccgctacgacggtaagaactggacatacgtcaacctcccgatcgaggacatcaaggagatggccatcgcctctctgaaagacagcaccatgatgtattactcctgcgacgtcggcaagttcctgaactctgaccgtggtctgctcgacgtcaaaaactatgattacgactcattgatgggcaccaccttcggcatggacaagaagcagcgtattcaaagctttgccagcagctccagtcacgccatgaccctcatggcagtcgatctggacaaaaacggaaaaccgaccaaatggatggttgaaaatagttggggtgccggagccggctatcagggacatctcatcatgaccgacgaatggttcaacgaatataccttccgtcttgttgtggaaacgaaatacgtgaccccgaaagcactcgaagtcttgaaacaaaaaccgatccgcctgccggcgtgggatccaatgtttgccggcgaagaataaccaaccgacaatcacgttgcatagacttgtgcgcgcaggtcttccagcctactttattaaagaacgtgtgcgaacacaaaaggaattacggatatttttccgtaattcctttcttttttcctcccgaatcacattattatttattacttttgcggcaaattttatgaaaccattattttatatagcatggcaaatgtaataaagttacgtaaaggccttgacataaacctgaaaggtaaagctgctgagacgtacacaacagtgaaagagccgggattttacgcactcgtacccgatgattttcctggagtgacaccgaaagtggttgtgaaagagcaggaatatgtgatggctggtggacccttgtttatcgacaagtatcatcctgaagtgaaatttgtttcgcccgtgagtggcgtagtgacgagcgttgaacgtggtgctcgccgtaaggtattgaacatcgtagtggaagctgccgcagagcaggactacgaagaatttggtaagaagaacgtatcctcgatggatgcagatgctgtgaagtccgcgcttcttgaagcaggtctgtttgcgtttatcaagcaacgtccgtatgacatcattgcagacccgacggtaacaccgaagggcatcttcgtttccgcattcgataccaatccgctggctcccgacttcgaatttgctctgaaaggcgaagaagcaaacttccagacaggtcttgatgccctcgccaaaatggcaaaaacttacctgagcatcagcgtgaaacagaaagccgctgcactgacacaggctaagaacgttacaatcaccgctttcgacggaccgaaccctgccggtaacgtaggcgttcagatcaaccacctcgaccccgtttcaaagggcgaaactgtgtggacaatcgatccgcaagccgttatcttcatcggtcgcctcttcaatacaggccgtgtgaattttacccgcacagtagccgtgacaggttccgaagtgttgaaacctgcttactgcaaacttcaggtaggtgcattgctgactaacgtatttgccggaaacgtaacaactgacaaagatttgcgctacatcagtggtaacgtgctgagtggcaaacaagtttctcctaacggattcctgggtgctttccacagccaactgactgtaatccccgaaggtgatgacgttcacgaaatgttcggatggatcatgccgcgcttcaaccagttcagtgccaaccactcatatttcagctggttgatgggcaaaaaggaatatacgctggatgcacgtatcaaaggcggcgaacgccacatgatcatgtccggcgaatatgataaggtattccccatggatatcatgcccgaatatctgattaaagcgatcatcgccggtgatatcgaccgcatggaagcgctgggtatctacgaagtggctcccgaagacttcgcactctgcgaattcgtctgctcttcgaagatggaactccaacgcatcgtccgtgtcggactcgacatgctccgtgctgaaatggcataatccgcatggcaaattgtaaattgtaaatcgtaaaatagtaatatattaatgaaagcgttaagaaattatctcgataagataaagccgaactttgaagagggcggtaaattccacgcattccagtcggtgttcgacggcttcgaaacattcctgttcgtgcccagcaagactgcgaaaacgggaacgcacatacacgacgcgatcgacagcaagcgtattatgtcgattgtggttatttcgttagtaccggcgctgctgttcggtatgtacaacgtaggttaccagcatttcacccacacaggtgctactggcagcttcatcgaaatgtttatctacggattcctggctgtattgcctaaaattatcgtatcatacgttgtcggtctgggtattgagttcgtcgtagctcaatggaagaaggaggaaattcaggaaggattccttgtttccggtattctgatcccgatgatcgttccggtagactgtccgctttggattcttgccgtagcaactgcattctctgttatctttgcaaaagaagtattcggtggtacgggtatgaatgtgttcaacgtagcgttgatcacccgtgcattcctgttcttcgcttatccgaccaagatgtccggtgacgccgtttgggtatccggcgataccatttttggtatgggacaggctgtagacggtctgactgtggctaccccgctgggacaagctgctacatcgggcacggttcctgcattcaacatggatatgataacaggtcttattcccggttctatcggtgaaacaagtgtgatcgccattctgatcggtgccgttatcctgctgtggacaggcgttgcaagctggaagacgatgctttccgtattcgttggtggtgcattcatggcctgggtattcaatgctatcggcatggaaaacaacacaatggctcagatgccttggtacgaacaccttgtattgggtggtttctgcttcggtgccgtattcatggctaccgaccctgtgacatccgcacgtacggaaagaggtaaatacatcttcggattcctgatcggtgtgatggctatcgttatccgcgtactgaatccgggttatcccgaaggtatgatgctcgccatcctgctgatgaacatcttcgctccgctgatcgactactgtgtagtacagagtaatatcagccgtcgcgagaaacgcgctgttaagtctaaccaataataccgaatgaaaatgaatacaaatagtaatagttatactatcatttatgcttcggtaatggttgttatcgttgcattcctgctggcattcgttagttcttcactgaaagctacacaagacaagaatgtgcagttggacactaaaaagcagattcttgctgcattgaacattaaaaatgtagaagatgctgatgccgaatatcagaaatatgtaaaaggtgatatgctgatgaacgtagacggcacgctgactgaaaacacaggtgagtttgccactaactacgagaaagaagtgaaagaacaccaacgtctgcacgtatttgtatgtgatgtagatggtcagactaaatatgtggttcctgtatacggtgccggtctttggggcggtatctggggatacgttgctctgaacgaggacaaagacacagtttacggtgtatacttctcacacgcaagtgaaactccgggtctgggtgctgaaatcgctactgactggttccaacacgaattcgcaggcaagaagacactggaaaacggtgccgttgctctgggtgttgttaagaatggcaaggtagaaaaagctgattaccaagtggacggtatctctggtggtacgatcacttcggtaggtgtggatgctatgctgaaggcttgtctgaataattacataagttttttaactaaataataaggaggaggataaagaatatgggacaactgttttcaaagaagaataaagaagtattctctgctccgttgggaatcgataatccggtaaccgtacaggtgcttggtatctgttctgcacttgctgttactgccaagctggaacccgccattgtgatgggactttcagttactgtgattacagcgtttgccaatgtcgttatttcactgttgcgtaagacgattccaaatcgtatccgtatcatcgttcagttggtagtggttgctgctttggttaccatcgttagtgaaattctgaaagcgtttgcatacgatgtaagtgtacagctctctgtttatgtaggtttgatcattaccaactgtatcctgatgggacgtctggaagcatttgccatgcagaacggtccttgggaatcattccttgacggagttggtaacggtttgggttatgccaagattctggtaatcgtagctttcttccgcgaactgctcggttcgggaactttgcttggtttcaatatcctgaattatgagcctatccagaatatcggttatgtaaacaacggtctgatgttgatgccgccgatggcattgattatcgtagcttgcatcatctggtatcagcgtgcacgtcacaaagaactgcaagaagaaagtaattaatataaatgaagggtgaagaaggatgaatgaaggtaacactcataaactcgaaattcttcattcttaatttttaattaaaatatatggaacatttattaagtttattcgtccgctccatctttgtggacaacatgatattcgcgttcttcttgggtatgtgctcatatctggctgtatcgaagaatgtgaagactgccgtaggactgggtatagccgtaacattcgtgttgctggttacgcttccggtgaactatttattgcaaaccaaggtgctggctgccaacgctatcattgaaggtgttgacctcagcttcctgagttttattcttttcattgccgttattgccggtatcgtgcaattggtggagatggtggtagaacgtttcagcccgtcgctgtatgcttcactgggtatctttctgccgttgatcgccgttaactgtgctatcatgggtgcttctttgtttatgcaacaacgcatcaatctgggtgcaagcgatccgaaatacatcggtgatgtatgggatgcgctgtcttacgcactcggttcgggtatcggctggctgctggctatcgtcggtctggctgctatccgtgagaaaatggcttactctgatgtacctgctccgctaaaaggtctgggtatcacatttatcactgtaggtctgatggcaatcgcatttatgtgtttctctggtttgaacatctaaaaagaaaggaataagacaatggatatgaatttaatattatcaagcattggggtattccttgtggttattctgttgcttgttgttatcttgctggttgccaagaaatttctggtaccgtcaggtaacgtgaaactaacgatcaatggcgaaacaggactggaagtagagtccggttccacattgcttaatacgctggccgtaaacggtgtattcctgtcatccgcttgtggtggcaagggttcttgcggacagtgcaaatgtcaggtactcgaaggtggtggcgaaatcctgccttctgaagttcctcacttcagccgtaaacagcaacaagaccactggcgtctgggctgtcaggtgaaagtgaagagtgacatggctatcaagattgacgagtctgtactcggcgtgaaagagtgggagtgcgaagtgatctccaacaagaatgtggctacatttatcaaagagtttatcgtggcattgcctaaaggcgaacacatggactttatcccgggttcttacgcacagatcaagatacctaaattctcaatggattatgataaggacattgataagagcctgatcggtgaagaatatctgcctgcatgggagaaattcggtttgctgggcttgaaatgtaagaatgaagaggaaacaatccgtgcttactctatggccaactatcctgcagaaggtgaccgtatcatgctgactgtacgtatcgctacccctccgttcaagccgaaagaacaaggtcccggatttatggatgtaatgccgggtatcgcttcttcttatatctttacgctgaaaccgggtgacaaggtaataatgagtgggccttatggagacttccatccgattttcgactctaacaaggaaatgatgtggatcggtggtggtgccggtatggctccgttgcgtgcacagatcatgcacttgacgaaaacattgcatacgaccgaccgcaagatgtcatacttctatggtgcccgtgcgctgaacgaagtattctatctggaagacttcctgcaaattgaaaaggatttcccgaacttcacattccatctggcactcgaccgtccggatcctgctgctgatgctgccggtgtgaaatatactccgggcttcgtacacaacgtaatttatgaaacttacttgaagaaccacgaagctcctgaagatattgaatactatatgtgtggtcctggtccgatgtcgaaagctgtagagaagatgctcgacgatctgggcgttccggctcagaacctgatgttcgataactttggaggataatcttcggaagttgatttccggtcggagaggaccggaagagtaacataaagaaactggcgggaaatctgtaaaagacaatggtgcttttcagatttcccgctttctttatgcactatcttaccgaatcttttcgtcctttttgtatctttgtccccatgttagagaaaaatgaaataatacagtccgctcttcagaatttgaagattgaatctttgaacccgatgcaggaagctgcgctcgaacagggcacgggcaggaaagatgttatcctgttgtcaccgacaggatcgggcaagacattggcttatcttttgcctctgttgcttaccctaaaaccgaatgatgacagcgtgcaggtgctgattctggtgccttcccgtgagttggctttacagatagataccgtgttccggagcatgggaacttcctggaaaacgtgttgctgctacggcgggcatcccattgccgaagaaaagaaaagcattgcaggaaatcatcctgccattatccttggtactccgggacgtatcaccgaccatctgtccaaaggaaactttgatcccgaaacaatcgagactttgattatcgatgagtttgataagtcgctggagttcggctttcatgatgagatggcagagatcatcacccagcttccgggattaaagaaacgtatgctgctgtcggctactgatgccgaagaaattcctcagtttacgggactgaaccggacagtcaaactggattttcttccggaggcaaccgaagaacaggaaaaccggttgaagctgatgaaggtgctttctccttccaaagataagattgatacgctttacaacttgctttgttcattgggaagcagctccagcattgtcttctgtaatcatcgggatgcggtagatcgtgtgcacaagctactcgaagataagaaactattagccgaacgttttcatggcggtatggaacagccggatcgggaacgggcattgtataagttccgtaacggaagctgtcatgtactgatctctaccgacctcgctgcccgtggacttgatattccagagatagagcatatcattcactatcatctgcctgtaaacgaagaagcgtttacacatcgtaacggacgtacggcacgttgggatgcaacaggtacttcttatctgattcttcacgcagaagaaaaactaccggaatatattcccgaagatatagaaacgatggaactgctggaaaatccttcacgtcctcccaaatctgtctggactactatatatataggtaaaggaaagaaggagaaactgagccggatggacattgccggattcctttataaaaaaggtaatctgacccgtgaagatgtaggtgcgattgatgtgaaagaacattatgcttttgttgccgttcgtcgggcaaaagtgaagcaactcctgaatcttattcaaggggaaaaaatcaaaggaatgaagactatcattgaggaagccaaataaagggagccgaaaaacaacaggtgttctcaaagctgaaaggtgaatttcaagaaccaaataggtgattgggatgctgacaatgacgagatgatcggctttgtcattacaaataatatcattcttttgaagtgagagacgtctctcatggatgacagactaaaatgatagtaaaaaaacaattctgtgacagtctccatttattttcttttaggaagatattggagactcctttctttctgactaatttttataattgtagtctcgttgcttgttagggtgagaaacccttgtttttctctgtctttcttaataaatattcattttgtaaccgttttcctttcactctgtaaccgattattttccacaggttatattttcgccttttatcccttgcttgatatgtatagataacaatatggtgtatatatcttgtataaaccaataaaaagaaagagaaatctgctttaaaacagtatttttataaggaaagatttgtgcaccggaaataaattcgtaaattcgcaaggtcaaaagacataaactaacgaaatgttaaaccaaaaacaaacttcaaatgaaaaagcataatttcaatgcaggaccttccattcttccgcgtgaggtgatagaggatacagcgaaggctattttagatttcaacggctctggtctctccctgatggaaatcagtcaccgtgccaaagacttccaacctgtggttgacgaagcagaggcattattcaaggaattactcaatatccccgaaggttattcggtactgttccttggtggtggtgctagtatggagttctgcatggtacctttcaacttccttgaaaaaaaggctgcttatctgaatacaggtgtgtgggcaaagaaagcaatgaaagaagctaaggggtttggtgaagtcgtagaagttgcttcttccgctgaagctacatatacttacatcccgaaagattacacaattcctgctgacgcagattatttccacataactaccaataacacgatttacggtacagaattaaaagaagatctcaattctccggttccgatggttgccgatatgtcttctgatattttctctcgtccgatcgacgtatccaaatatatctgtatctatggtggtgcgcagaaaaatctggctcctgccggtgttacatttgttatcgtgaagaatgatgcggtaggtaaagtttctcgttacatcccgtcaatgctgaactatcagactcatatcgataacggttctatgttcaacactcctccggtagtgcctatctatgctgcactgttgaacctgcgttggattaaggcacagggtggtgtgaaagaaatggaacgtcgtgctatcgaaaaggctgatatgctgtacgctgaaatcgaccgtaacaaactgttcgtaggtactgctgccaaagaagaccgttcacgcatgaacatctgtttcgtgatggctcccgaatacaaggatctggaagctgacttcatgaagttcgctacagaaaaaggtatggtaggtatcaaaggacatcgttcagtgggtggtttccgtgcatcttgctacaatgctctgccgaaagaaagtgtacaagctttgatcgactgcatgcaggaatttgaaaaacttcattaataatataaatagagtcaccacagattgcacggatttacactgaaatcttattgaatatagtgtgtaggccggtgaagtctgtggtgaatcttttttaaaagatacagataaattatgaaagtacttgtagctactgaaaaaccgtttgccaaagttgctgtagacggtatccgtaaagaaatcgaagcagccggatatgagcttgctttgctggagaaatataccgataaagcacagttgctggatgcagtgaaagatgctaatgctatcattatccgtagtgatattattgatgcagaggtgctggatgctgctaaagaactgaagattgtagttcgtgctggtgccggatacgataatgtagacctggctgccgctaccgctcacaatgtttgcgtgatgaatactccgggacagaactccaatgctgttgccgaactggctttgggcatgatggtatacgccgttcgtaacttctataacggtacttccggtacagaattgatgggcaagaaactgggtatccatgcatacggaaacgttggtcgtaacgttgcccgtgtagctaaaggcttcggaatggaagtgtacgcttacgacgctttctgcccgaaagaagtgatcgaaaaagatggcgtgaaggcacttgactctgcagaagaactgtacaagacttgtcaggtagtgtctcttcatatcccggcaactgctgaaacgaagaactctatcaactacgctctgctgaaagatatgccgaaaggcgctatgctggtgaacactgcccgtaaggaagtgatcaacgaagccgagctgatcaaattgatggaagaccgtgctgacttcaagtatatgacagatatcatgcctgctgctaatgcggaatttgctgagaagttcgcaggacgttatttctctactccgaagaagatgggtgcacagactgccgaagcgaatatcaatgccggtattgctgctgctcaacagattgtcggtttcctgaaagacggctgtgagaagttcagagtaaacaaataatgagatgaatcgtaagactgcttatcgttgctcagtcacttatttgatgataggtgctggtcattaagcagtatatttagaaatatgttatcagatttcgccctcggcttttgcgagggcgtatctgttctactaatcttaaaacataccatgacttatggctattatcaaaccttttaaaggcgttcgccctccacaagacctggttgaacaggttgcttcccgtccttacgatgtattaaactcagaagaagcgcgtacagaagcagctggaaatgaaaaatccctttatcatatcattaagcccgagattgactttcctgttggtacggatgaacacgatgaacgtgtttatgagaaagctgccgaaaacttccggctgtttcaggataaaggctggttagtgcaggatgcaaaggaaaactattacatctatgcccagaccatgaacgggaaaactcagtatggactggtagtaggcgcttatgttcctgactatatgaacggtatcatcaagaagcatgagcttacccgtcgtgataaggaagaagaccgtatgaagcacgttcgtgtgaacaatgcgaatatcgaacctgtattctttgcctatcccgataatgcgaaattggatacaatcattcggaaatacacagccgaaaagcctgtttacgactttatcgctccgggtgatggcttcggacatactttctggattgttgaccaggacgaagatatcgctgcaattactgcagaatttgctaaaatgccggcattatatattgccgacgggcatcatcgttccgctgctgctgctctggtaggtgccgagaaagcaaagcaaaacgcgaaccatcgtggcgatgaagagtataactatttcatggctgtatgtttccctgccaatcaattgactattatcgactataaccgtgtagtaaaagacctcaacgggctgactcccgaacaatttcttgctgcattggataagaattttgttgtagaagaaaagggtacagatatctataaaccgtccggtttgcacaatttctccctctatcttggcgacaagtggtatagtttgacggcaaaggcaggtacatacaatgacaatgatcctatcggcgtgcttgacgttactatttcttccaatctgattttagatgagattttaggaattaaagacctccgttcggataagcgtattgactttgtaggcggtatccgcggtttgggagaattgaagaagcgtgttgacagtggagaaatgaaagtagctctggctctttatcccgtatccatgaagcaattgatggatattgccgatactggcaacattatgcctcccaaaacgacttggtttgaaccgaaacttcgttcaggactggttatccataagttggattaagacatattctatatagaaaatagagcggtcaatctctcacaatcaacaggacatttgtgagagattgaccgcttgtttttgtataaatgaccgcccgattccgttaaaacgaccacccgactacctccaattgactgcttgattgcaccccatcgaccgtttgactgcatgaaatgaagcgctcgtttcaatgagaagctctaatattttcgaacagcagatggaatttcgtcaagaaagccgtatctttgcggcatgactgctgaagatacttataaaactatcgtcgaaccttccgaaggtatttatacagaaaagcgaagcaagtttattgccatcgccttgcctgtgcgtacccttgatgagataaaagcgcatcttgaaacgtatcagaagaagtattatgatgcacggcacgtgtgctatgcttatatgttaggtgcggcgcgaaaggattttcgagccaatgataacggtgaaccttcgggaacggcgggaaagcccattctcgggcaaattaactctaatgaactgactgatattctgattattgtagtccgttatttcggtggaatcaagttaggaacgagcggactgattgtagcttataaagcagctgctgccgaagcaatatctgccgctaccattatagaaaaaacggtagatgaagaagtgaccgtaatgtttgaatatccttttatgaacgatatcatgcgtattgtaaaggaggaagaaccggaaattctcagtcaatcgtacgatatggattgcagcatgacgttgtgtattcgtcgttccatgatgcccaaactgcgtgcacgattggagaaagtggagaccgcaaggattcttgatgaagagtaaaataaagaaaaataagaatatatggcatttgaagcaacaaaaagagaatggtgtgaactgtatactttcttccgtctgctgacagaaggaaaagtaacgttgggtacggctaaggcaaagaaaggagaaatcgactggcctattgcaatgattcaacgggaggaacatgacggaacacgctgctactatatagaaaaagagatggtccgcatcaaaggagaaaatagtgagaaattcgttccccgggaagattttgggattgtggcagatttgattttgcaggctgtcaagtcctcttcggaggatgaagtcacttctccggatggagtggaagagtttttggatgaagtcgcaattttcgatctggaagcgaagacggaagatcgtaccgatttttatattgccttctggcatccggaggcaccgttgagcgggttcagcgttcgttcgcgattgggtgctatgaatccgctgttggacggaggccgtgcggctaacttgaaactggaacagagcggagtcaaatttgcaacacctacggtgaataagattaatgcgttgccggaagcccctaatgaagtagcagaacgaatgttgctgattgagcgcttgggtggtgtactcaaatactcggacgtggcagatcgggtattccgtagcaatcttttaatgattgacttacactttcctcgtgtgctgacagaaatggtgcgcatcatgcacttggacgacatcacccgtatcagtgaactgacggaagtaatcaaacagatgaacccgttgaaaataaaagatgaattggtaaacaaacatggtttctatgagtttaaagtgaagcaattcctgatggcattagccttgggtatgcgtccggcaaagatatatactggacaggattcggctgttgaaggtatcctgttgatggatgggagtggggaagttctttgctatcacaagtcagagaaaccggttatggaggacttcctgttcttgaatacccgtttggagaaaggttctctggataaggacaaatacggctttttggaaagagagaacggtacgtattacttcaaactgaatgcaaagatcggattggtaaaacgataaatgcaagtggtgaacgagttgtaagtatagtaaatatagtatatgaaaacgaatgaagttttagaaaacatcaaagcacgtcgtagtgtgcgggcttatactgaccggcaagtttcggaagaagacttgcaggctattctggaagctgccacttttgcacccagtgggatgcatttggagacatggcattttaccgctattcagaatgcagataaactggcagaattgaatgaacggattaaaggcgcttttgctaaaagcgatgaaccgaaattacaggagcgtggtcatagcaaggcgtattgctgttattatcatgccccgactttggtgatcgtgtccaacgaacccactcaatggtgggccggcatggattgtgcctgcgcgattgagaatatgtttttggctgcccattctctgggaatcggatcttgctggatcaatcagttgggtacgacttgcgatgatcccgaagttcgtgaatttataagttctttgggtgtaccggagaatcataaagtatatggctgtgtagctttaggatatgctgatcctaaaatctcactaagggagaaaatggtaaaagccggaacagtgactgttgtcagatagaaccagactatgttttcgacaaacatggaatgaagagcagcatgataaccgtaaggtttcggagtcgcttcttatgttcatttagctcggtgcttattggaatacgctcggtgcttaacaaaggtaagcccggagctcacatctgctgagctccgggcttattttttcatgtacggatttcctttgaaagtttcttcttattcgaacgttccgtagcgggtcggcaataatttccggtctcccaacgtattgtctacgcgagccacattcacccagaacttattctcacgcacgctttctatcggatacgctgctttctcacgtgtgtaggaatgttcccagttatcattcacaatttcatattccggatgcggggcgttgactaatacattatcattcttatctgcttcttcgtttttcacttcctggatttctttccatatattcagcatgacgtctataaagttgttcaactccgccaggctttcgctttcagtaggttcaatcatcaatgtgccgtgaacagggaaggagagagtcggtgcatgatagccgtagtccatcagacgcttcgcgatgtcattttctgagatacccgtttcttcatgtaccttgcggcattccagaatcatttcatgtccgacgaaaccggtagctccccgataaacaataccgtaagtatcttttagacaggcagccagatagttggcattgagaatggctattttagtagcctgagtcaagccttcggtacccatcatccggatgtagccgtatgtgataggcaagatacccgcactgccgaacggagctgcggaaacctgattttgcgtactgccgaagatcgaatgtcccggcaagaatggaaccagatgctcagctacacagatagggcctacacccggaccgccgccgccatgtggtgaagcaaacgtcttgtgcaaattcaagtgacaaacgtctgcacctataaatcccggattggtcaatcctacctgtgcattcatgttggcaccatccatatatacttgtgcgccacaagagtggatgatttcacagatttcctttatttccgtctcgaagataccatgcgttgacggataggtgatcatcagtgcagccagtgcttccttgttctcttcggctttggcacgcaggtcgcccatatctacgtttccttgctcgtcgcaagcgcaggtgacggtttcaaatccggcttgtatggcagatgcaggattcgtaccgtgtgccgaagccggaatcaatattttgttgcgatgtccttgaccaatactttcaagatacgcacggataactcgcagaccggcatattctcccgcagcacccgagttcggctgcaggctgacacctgcaaatccggtaataaccttcaagtcctcgctcaaattgctgatcaattcacgatatccttccgcctgatcttccggcaccaacggatgcatgctcataaattccggacggcttaaaggaagcatttcagcggctgcgttgagcttcatcgtgcacgatccgagggaaatcatggactgggccaatgaaatatccttccgatccagacgtttgatgtagcgcatcatttccgtttccgtatgatagttggagaacacctcgtgcgtgaggaaaggcgtggtgcgtttcagtgctttgtcaatattgctcttttccggcacgtcctctaccttctgataatctttcccagcggcaatggcaaagatggaaagcaacacgttcgtagctgctacgtctgtcgtttcatcgatgctgaaacctacgtctccgttctcgtaatagcgcaggttcacttccttgcttagtgcgatcgtgcgaatctgctgcgccgaaacgtgttccggcaactcgaaacgtagcgtatcgaaatattgtgcattgacttgcgtatatccgaatttctttaattgcttgtcgaggaagacagtgatgctatgaatacgcgaagcaatcgttctgattccttcctgtccgtgatatacagcgtagaaacctgccatcgtagcgagtaatgcctgagccgtgcaaatattggaagtggctttttcgcgtttgatatgctgttcgcgtgtctgcaaagccattcggtagcagagtttgccgtatttgtctttggaccatccgatgatgcgtcccggcatgttccgcttgtactcgtcacgtgtggcgaagtaggctgccgaagggccaccgtaaaacattggtgtacccagacgttgtgttgtaccgaatacgatatccgctccccattctcccggaggagtcagcagggcaagactcagaatgtcagcggcaacggcaactttgcagtctgcttcatgtgccttttttgtgaagtcggcatagtcttccacattaccgctggagttaggatattgcaggatgcaggcgaagatttccggtgagggttcaaactctttatatttgcctgtgcgcaattcgatgccttgtggaatggcacgtgtggtcattactgccaaggtctgcgggaagatgttttcgtccacaaagactatgttggcacctgctttctgttgggcacgcgaacgcagagcatacatcatggttacggcttcggcggcggcagtcgcttcatccagcagtgagcagttggcgagcggcatagcggtgaggtcacagacggcagtctggaaattcatcaacgcttccagtcttccttgcgacacttctgtctgataaggcgtgtaagaagtataccatacgggattttcgaatacattccgttggataacggcaggagtaatcgtattataccaccccaatccgatgtatgtcgtatacagtttgtttttacttgccaggtcggcaatgtgttttccaaattcgtattccgtcaacggcttggccagtgccagcggttccttcagtcggatgttggcagggatggttttgttgatcagttcatccagtgagtctacgcctattttgcggagcatcacagctgtgtcttcttcattgatgccgatgtgacggctagctaacaaatctgttttcataatttatgggggatgtttttaagtaatagataataagtaataagtaatatccatgcggataaatatactggcagctacgattattacctgttacttattacctattacttgtattcttttttttatctgaaaaatggattctctgccttctccattccgatggtcgttggcgcaccgtgtccggggtatacgactgtctcgttgggaagtacgaataaacggctgcaaatatgatcgatcagttcgtcgaagttgccacccgacagatcggcacgaccgatgctgccttgaaacaatacgtcgccggagaacatgcagttttcttccttgcaataatacaccaggctaccgggcgaatgtccggggacatggattgcttccagtttggtgtgtccgaaagtgatgatatctccgtcatgcagatatttccccaacggaaccggttcttcctgcaattggaagccgaacatacggctctgtttcggagcttcatcgatccagaactcatccgccttattggcttctgccgacagaccgaactctttcagcataaacggattgccgaagatgtgatccagatgtaagtgagtattcagcagatgtttcactgttaactcattggtgaggatgaacttctttagtgcttgtttttcctcttcgtagaagcagcccggatcgatgacaaccgcctcttttgtgtcatcccataaaacgtagcaatttacgggaaacatattaaactcaaatctctttattttcatggttttgataactcctgattcctatatttgtgaatatactaccttctttgtttcaaagaactcttcctcgaagttttcgctcaggctgtggatgactgttttatgcttgaacggcatcgtttcatgctccagttcgcctcctttgagacagattagtccgttgggcaaagcattctgctgtttgggggaaatgttctttttgatgatcttgatcagatccgccaaaggcattacggcacggctcacgacgaaatcgaactgttgtttttcctcttcggcacgggcatgacggaaagtgacgtttttcagtccgatggcattggccacttctgtcgccacacgtactttcttgccgatgctgtctaccagatgaaacttggtttcggggaacaggatggcgagcggaatgccgggaaatcctcctcctgtacccagatccatgaccttggttccaggacggaattgaatcactttggcgatgcctaatgaatggagaacatgatgctcgtacagattttcgatgtctttgcgggagataacgttgattttcgcattccagtcgatgtagaggtcgtatagagcggcaaactgtttacgctgctcttccgtcagatccggaaaatatttcagtatgatttccactttaagtattttgaatggtgaattttgatttataagtgaaatgaatatccttctgcatcacacggggcaataacaacaggatattcattggtgttcaatcttttaatagctgtttaatctttcaggtctccaagaattgggttgctgcccagcagatgttccatcatagagtatggaatggtaactttgacaggtcccatcgagtacggtgtgatgtcgtatatattatagtagaaggtgataccttctttactcagatagaagttctctgtcggggcgatgtctccggtcgaagcatatcccatgtcttccagcgcttcgtgagtagttactttgttgtcagccatcagctggttccagatcagatccgtcagggcttcctggaagtcgcctacaaaaatatcatcgaggcggagcggacgcatcagagtgagatccatgttcaggaaagtcgacatatacataccgtgtgcgcctccggtatattcgttgtagtcaacgcgatatactagcaggtctttctcataaagttgcacgtggctttcgatgctcttgtaataggagtaccatgcgcctaccactgcatcgctttctttattcttttcgtcttcggcgtacatcggctcttggtcgtggcgatactcgtcaatgtaattcttggcgtattgcttcactaccgcttctggcttttcgccgatatatttgtctccgaagcagacggagatgaagtaagcgttcagactgtctttcagcatctcgtccgacgacttgacgggataggcgaagttgatgataatattgcacgcgggtttggcggtgtcattaaagaggtgtgccgtctcgttaacctgtatactatcgaattgtaatgctcccgtgtttttgttcatcttgtcatgacaagaaaacaaaaagccgcttaccgaaagtataaccgcaagcagactgacatattgttttttcatactcgttttttctataaattcaacattgatcatatctatcactatcgacaaatataaatgaaattaccgaatactgcgaataaaaaaggaaaaatattcagctactttctccggcaatgtatataggggatgccattgttaatgattctttttttcttgcttctgtatcatatgttacagttttaatctgtacgccgtacttatctttgcagaaaaaatagattatggaacagttacatgcacacgaagtccttcacatgatggagggaaatagttatactgaggcatctctgagggctgcaatcgtagagaagtttggcgaacatcagcgtttttatacttgttcggcagataatatggaagtggacgaactgatcggatttcttaaacgaaaagggaagttcatgcctgccggtgaggaatttacggttgatatcagtaaggtatgcagtcattgattctctgtggcggacggtatgatagataagccaataggatagttgagagaagaaatgttagtagtcataggttatacctgtcgtttttcatagatagggaaattcctatttgcaagtaggaagaagtctttgcgaagggaattttctcatactacatttggggtattcaaaaaaactactaaactatacctattatgaaaaagagtcagatccttatgtctttgctgctggtgatattgctcagcagttgttatgcaagcagaattacttatgagaatttgagtattatccaacgtgggatgtcttctaaagaagtaatagccattatgggtaaaccgagctatcgaagttttgacgaagagagtgagatgctggaatttcgtacttccgagtcaagtattgcaggagtcgttaatatctggttcgttgatgaccgggtgactaagatgaaaagttatcataccaatggctgtatggaccggaacagagccatagaggataaggaagaggaggaatctgcaaagaaggaaaagaaagaaaaagaagaaacaagcgcccgcatacgtgtgacgatggacggaaagcatatcatacagaccggttccatcatagtcactccggatggaaagcacgagacggtggtcagtgattgtggtggagtaatcataacagcttcgggggagcatatacttgctccttaatgccttccgtcaattcaccatacccttgtcaataccaaatttctcgtctgtctgacattcgccggcaggttccacgtgtactaagatatcatagacattgtctatagagctttttatgcttttctccacagcgtcggctatctgatgggcctgtgtgatggttatctgcggatttacctcgatatcgagggtaatcatataaagattcccgatcattcttgatcttacccggtgtgggttgctcgcaccgggaactgtttctactgcttcgaatatcttattgtacacattgacatctttgacgccatccatcaattccacattcgaatcgatgaaaatgccaatcgaagattttatgataaagaggctgatgattagtcctgtgatggagtcgagtataggcagtttgaatatgaacgtgaatatcagtcccagcagcacaccggaggaaatgataacatcattgcgcatattgatggcattggccgtcagcatggagctatctatctttttcccttgtttgtactgatataaagccaatagaagtttgccgataatcgaaaagatcgtgacgtatatggcaatggctgacggaatttcttttgcttcttcggaaaagatacttccgatagatgatatcaacatttgcacccctgcatagaatatcacaagcgaaagaattttagtcgcaatcccttcggctttctcatagccgaatacgtacttcttggaaggcggctggctgataatgcgtgctgtgaaaatcatgacaatggagatgatcacatccgttgccgaatcaataccgtcgcctagcacggcaagactgccggcccataaacctacgatgatttttgatgtggaaagtatggcattaccaatagtactaatccaggaagttctgattaatatctgctctcttttagctttcatgtgattaagcctttgacattccggttagtatatagctgcctttcaagttattttctttcatataattgactacttctatccggcaagctgacattaaagcgtatcctgttaagttcccgtttatagctttaatgaacgaatactctgtatcgttgtggatgaaagatatacgatgatattccatgacatgatgtatttaaaagaactaatatgtggtcaaatatacggataatatcagtagtacgaataaaaatggagaattatttaatttgatattgttgccggaataccttatctttgtctcccgaaatgaagagactagcctacataacagcagtgatcctttctctcctgattatctattcaggggcgggagtatctattgttcattattgctgttcccgttgtgagactgtgcagggctgttgtgccgatggctgtcccaaatgtaagaagtctcatacttgcgattcaaagaaagattgtagagaaaagggctgtacggcaactatctataagcccgatttgatgaagcatatttccgaactgacagtttccgttccggtgataacacttttctgtgaacagtattgtcagctatttgctttcacttctatagaccggacggtggacttttccagtcttccttctccgccatctccctgtccgaggcagaagctggcgttacattccgtttttctgatttagctgttatttcatcttttttgtccgattgtactttgttttcagcctttgcagggtatgaaaacaaggagaatgaatgcaactcagttgcaagagaaatgaattaattttgtatcgcaaaactaagtccaagaaagaatgaaatatataataatgggactgttctcattacttgcagttacgacacaagcgcaggtgcggggaatagtcaaagataataccggagagcctgttccgggtgctaatgtattctgggtgaatacggagcagggtgtaactaccaaggaagatggcagcttttctatctccaaaccttcgaagagtcacatgttggtaatcagttttatcggttttcagaatgacacgattcatgtcagcaagaagaatcaggaactggacattacccttcgggaaggtgtagaactgaacgaagtgaatgtagtcagccgcagaatgggaacgatgaagttgcgcagcagcgtaatgaacgaagagatgataagcagtgccgaattgagcagggctgcctgctgtaatctgggagaaagtttcgtgaccaacccttcggtggacgtgagctattcggatgcggcaacgggagccaagcagatcaaactgctcggattgtccggaacttatgtacagatgctcacggagaatatcccgaactatcgcggtgcggcatctccttatggtctgggatatgtccccggtccgtggatgcaaagcatacaggtttccaaaggaatttcatcagtgaagaatggttacgaagccatcacgggacagattaatgtagagttcaaaaagccgcagttgctggaggccgattgggtatctgccaatcttttcgcaagcagtaccaaccggtatgaggcgaatgcggacgccaccttaaagttgtcaaaacgttggagtacctctttactggcgcattatgaaaacgaaaccaaagcgcacgacggcaatgatgacggcttcgtggatatcccccaagtagagcagtataacgtgtggaaccgatgggcctatatgggagatcattatgtctttcaggcaggcttcaaggccctttccgaaagtcgcactagcgggcaggcacatcatacggatatgcagacgggtgatctttataaagtaggaatcgataccgaacgttacgaatttttcaccaagaatgcttatatatttaataaggagaagaatacgaatctggcactgattctttctgccagttggcacaatcaggatgccatgtacggacgaaaactatacaatgtagaccagacaaatgtgtatgcctctttgatgtttgaaacagagtttaataagcagaacagtttctcggcggggctgagtttcaactatgacgcttatgaccagcattatcggttggagaatcaaacggaattgccgctcatcaaggcttttgccaaagaagcggttcccggagcctatgcgcaatacacgctgaatctgaatgatcagtggatgctgatggcaggtctgcgtggtgactatagcaatgagcacggtttctttgtgactccccgtgcacatcttaaatacaatccgaatgagtacgtacacttccgcctctctgccggaaaaggttatcgtacgaatcatgtactggcagaaaataactacctgctttccagtagccgaaaggtcgaaatagcgaaaggactggacatggaagaagcatggaactatggtgccagtgtatctacctacgtacctgtatttggcaaaacgctgaatatcaatgccgaatattattacacagacttcctgaagcaagtcgtagtggatatggacagtaatcctcacgaagtagccttttacaatctggacgggcgttcctattcgcatgtattccaagtagaggcaagctatcctttctttaaaggatttaccttgacgggagcttaccgtctgacggatgctcagaccacctacaaaggccaacggatggagaaaccgttgaccagcaaatacaaaggactgctgaccgcttcgtaccagactccactcggaatatggcagtttgatgctacgcttcagctcaatggcggaggaagaatgccttccccttatgagttggcagacggtcagctatcttgggagcgccgctatggcagcttcgagcaactgagtgcccagattacccgctatttccgccgctggtctgtttacataggaggggagaacctgacaaacttcaaacagaagaatccgatcattgacgcagcaaacccgtggggaggaaacttcgactcaacgatgatatggggacctgtgcacggggcaaaagcctatatcggaatacgtttcaatctggcaagaaatgaataataaccattaaacgaataagaaaaatgagaataaaaagatggatggccacttgcgtggtggctcttttgagcgtagcagccgtgttggcaaaggatatccgtgtagtagtattcaaagtctctcagatgcactgcgagaactgcgagaagaaagtgaaaaataacatgcgcttcgagaaaggcgtgaaggaactttccaccgaactgaagaacaaaaccgtgtccatcacctacgatgccgaaaagacagatgtgaagaagttgcaggcaggattcaagaagttcaattatgaggccgagtttgtgaaggaaaccaagcaggacggcaagaaagatagcaaacaagaatctaagaaagaggataagaaggccgataagaagtaatcgaacaaatacccgtatttgcttgttttataaatactaattaattaaagagtaaaggattatatgggtaatatagcaaaaaaagcgtttcccgtgcttaatatgcattgtgcgggatgcgctaacaatgtagaaaagacagtgaaaaagttgccgggagtcgttgatgcttccgtcaactttgcttcaaatacattgacgatttcttatgaggacgacaagctcacccccggagaaatccgtgcagcggtacttgctgccggttatgatctgatagtagaagaagcgaataaagaagaacgtcgggaagaagaacagcataagcgctaccttcgtctgaaacggaaagtgatcggcgcgtggatatttgtagtgccgttgcttatcttttcgatgttattaatgcatatgccatactctaacgagatacaaatgttgcttgctattccggtaatggtgctcttcggaggaagtttcttcacgggggcatggaaacaggcgaagatcggtcgtagcaatatggatacgctggttgcgttgagtacctcgatagccttccttttcagtttgttcaacactttctttccgcagttctggacagatcgcggactggaaccgcacgtctattacgaagcttccgcagtgatcattgccttcgttctgaccggaaagatgatggaggaacgcgccaaaggaaatacctcggatgccattcgcaaactgatgggaatgcagcctaaagtggcacgtgtattgcgtggcggggtagaggaagagatacaaatagacctgttgcaggtaggcgatatggtggtagtccgtcccggcgaacagattcccgtggatggtcagctttcggagggcgattcgtatgtggatgaaagtatgattagcggtgagccgattccggtagagaagaaaaagggcgataaggtccttgccggaacaatcaatcagcgcggttccttcatcattcgtgcttctcaggtgggaagtgatactgtgctggcacgcatcattcacatggtgcaggaagcacaaggcagcaaagctcctgtgcagcgtatcgtagaccgtattacaggcatcttcgttcctgtcgtgttgggaattgccattctgacgtttgtgctgtgggtagctatcggtggcagtgagtatatttcttatggtattctttctgctgtatccgttctggtcatagcctgtccctgtgctctgggacttgccacacctactgcgctgatggtgggaatcggtaaagctgccggacagcatattctgataaaagacgccgtcgctctggagcagatgcgtaaggtagatgtggtggtactggataaaaccggtactttgaccgaaggacatcctaccgctaccggatggttgtgggcacagccgcaggaagaacacttcaaagatgtacttcttgctgccgagctgaaatcggaacacccgttggcaggcgcgattgtagccgtactccaagacgaggaaaagataactcccgctcctttgagcagttttgaaagcatcacaggcaaaggtataaaggtgtcttatcaaggtaagacttactgggtgggcagccataaacttctgaaagatttcagcgctacagtaagcgatgtcatggctgatatgctggtacactacgaatcagacggaaacggaatcatatacttcggacgtgagaatgaacttttggctatcattgccgtttccgacccgatcaaggctacttctgccgaggcagtgaaagaactgaaacgtcagggcattgatatctgtatgcttaccggtgacggtcagcggacggctctggcagtctcttcccgtctgggtatcgagcgatttgtggcagatgccttgccggacgataaagccgaatttgtgcgtgagctgcaaatgcagggaaagaaagtggcaatggtgggcgatggtatcaatgactcacaggcactggcgttggctgacgtcagcattgctatgggaaagggtacggatattgctatggatgtcgctatggtgacgctgatgacgtccgacttgctgttactccccaaagccttcgaactgtccaggcagactgtacgactgattcatcagaaccttttctgggcatttatctacaacttgatcggtattcctatcgctgccggagtattgttccctataaacggattgttgctgaatccgatgctggcaagtgccgccatggcattctccagtgtgagtgtagtgctcaattcgttgagtttgggaagaaggaagatttaaacatcgaaagggagcgtggtaaagttcctttataactttaaattaggcatggattacgcggattaacacggattttaaacctttagaactgtgtaattcgcgtaattcgtgcctaaatataatgaagattggttatatgtagcctctatccatgatataggttttgattacaaacctcaactatttctaaattccagcggtgacatccctacgtgccgtctgaagaacttgcagaagaaagagggattcgggaaattcaacgaataagctatctcctgaatagtcatatccgtaccctttagctgcgctttggcgtcgataatgacaatataagcaatagtatccaatacacttttccccgtcacttgttttacggtagtgctcagatgttgcagagagattcccagctgatcggcatagaactgtgcacaacgctgatctttgtagtgctcagtgatcagttgaatcagcttccggcaaatctccttcttgcggttcgaatgattgtttcccgaataattccggtacatcagctggacacttgtcagaatagtctggagtgataagtccgccagtttggagttcatcttgaaagactcgtcacaactggcatgagacaacaaggcaaaatattccttcagatagtcggcgatattctcggaaggagggatgatcggctgttctatcagcttgggataagcgttcccgatggtggtcagcaagttgatatgtccgatacatttcgcagagaatccggcaaaacaaagactaaccttttccgctttctcacggaactgtatgattgttccgggaagtaatgtaatcagatcattcgggtgaacctcgtattccaacagattgatggagactttcatggttccttccgtacagatggcgaaaatacacgcctgcagccggcacgattgtttgtagatgttcagaatatcttcggttactttagtccatgccaacacctccagaggcaaatctacttgtggaacttccattttcataagagtgtttgttatctttggtttagagtgcttgttatattcggtccgcaaatgtacgatttttctttttatttcttacttttgtcttcatgaaaactgtattagtagactggaatttgattccatacgccgaggcatggcagcggcagacagaatggtttgatacccttgtctgcgcaaaagcgcagggagaaccgtatgaaaaccgtattattatgtgcgaacatccgcacgtctatactttgggacgtagcggaaaagaaaagaatatgctgttgaatgacgatcagctgaaagccattcaggctacccttttccatatagatcggggaggggatatcacgtatcatggtcccggacagctagtctgttatccgatcttgaatctggaagagtttcatctggggctgaaggaatatgtgcacctgctcgaagaggctgtgatacgtgtctgtgcctcctatggcattgaagcgggacggcttgaaaaagcaacaggtgtctggctggaggggagtacgccccgtgcccgtaagatttgtgcgatcggagtgaggagcagtcattacgtcaccatgcacggactggctctgaatgtgaatacggatttacgctatttcagctatattcatccttgtggctttatagataaaggcgtcacttctcttcgtcaggagctgaagcacgaagtgcctatggacgaagtaaagcaacgcctcgaaggcgagcttaacaggctgctgaacgaaaaaaatcagcagattgctcaatgaaagaacccagcagactctgctcaatgataaaacttagcggactgcccgaaggaaaaacctagaaaacgattccaatgccgagctgccatgtcttatgcatgaaacagtctttatcagccagtgcataagagaaatctgcgcgaatcggccagaagttgattccgcagcccagtgtaccgtagttgcctgttcctttgtcgttatccccgaagtggtatcctccgcggataattccatatttcaggaaattatattccgctccgatgccggcttgaagatggcggtactcggacgggagcaggtagttgaagtcaagagccacctgcaagcggttgtccatactgaacggcaggtcgatggcaccacccagtcccagtcgggcaggcagtttctgtccgtccagcttgctacccaggttggcggcttgaaatccgattgtccatgaagccatttcgtccagaatacccatgctgcgatggtagctggcaccgaggtccacggagactgatcctttgctgtccgcatccttataggcttttgcctgcagatatctgagtgttaatgaaagggacaggttcttggctacatttctgaagtatgcggcttccacgttccatgcgcgggcatgatcttctgcaccgtcctgccaatgaaaatcagcatccttgtagtgacggaatcctacgctaaatccgtgcttcccttcccgtccgatgcggtagaaaagggatgcgctatgcattccaaagtctttatttatgtcagcgtatgagtagctggcacccattacatcctgcgagaaagcgatggtggaagcgttatgaaagatagccgtgcttccattgtcagtgatagccagtcctgtgccggccatacctgccgattgggcatccggagtaatctccagaaaagaggcgcttgccactccctgtgctcccagaaaagtaggcaacagacacgacgcgagaaggaaatgttttactcgtttcataatcatttgttttaagggtgagacatccggacgacacgtatgccgctccatgatttattattgtgaagcatttggctgagaggctcttcgctgacaacaaccttgccaagcgtagaagaggcgtgaagcaaatgcaactttccgtttatatattcggctatccctacatgagctacatccagtcccgaaagattcgtggtgatggcaatgatatcaccgtccatgatccacggaagtcctgcgtcggagagtttgcctttaggcagccagtgtacctttttcccggacaatgccttttcatgctcggccatccgtttcacgttctccggcgaatccgccagttgcctgtacttttggggatgggtggacatataagagagagacagtttggtggtctgcgtactgttttgtgcagtaacgtcttccagaaatccttggcggacaccgttctcaatccagtcggaggtatagtgcaaccgcgaagtgtatccgtcgatcacaccgtcccgataacgtatcttttgcagattatcggcaaaagaagaccccatcgcctgagccagcgtatattcgacgaaagtaaggcaatctaccgtttggggcaggatgattaacttttcttccgttccctgatccagtgtgttggctacatactttgttccaaggtacgtctttccgattctcaacatcggtgctgtctccttcggaaatacgacaccctcacgcaaccacttttcgagttcctgtgtccattgttgcttatacttgaagttgtcccggaatccccagccatgtccgccggtagggtagacatgaagcgatgcgggaacattgtttttctgtaaagcgagataatagttcactccgttggaaggaggcacggcaccgtcatcagaagacaggacgataaaggcttgcggagtatcggatgtcacttgcagttcgttggagaagagtaccttttgttctgcggtcggatttccgcccagaagctcttttctcgaaccgccatgagtactttgcgtcatggtgaccaccggataaagcagaatctgaaagtcgggacgcgatgccgcactgtaatgggtggcaagggtagaggcgagatgtcctccggcggatgctcccatgattcctattttgcggggatggatattccattctccggcatgctcgcgtacgatgcgaatcgctctttccgcatccgataaggggacttcgcaatgaccgttcggcatccggtactttaatacaacgtaagtgatgccctgtccgcagaaccagggtgccatatcgtgtccttcatgatccatggcgaggcggctgtagccacctccgggacacatgatgacagccattccgttcggctgcggtgcacggtaaacggttatggtggggtcggtgacattgctgattctgtggggtgacacttccttttccccgccggtcagtccgttggagttgggagcaccgtcgggccacaaaggtagctcgacgggctgttgtgcaaatgtcattgcagtcataagtgatactataacagataacagtttcctcatcttattttactttcatggaagccttgataaagtagaggatcaataaagcgtaagctcctaatgctaacacttccgaccaggtattgttcagccaggcttcgttgaccagattgataccgccgaaacgcattgccgcgctcactactcccatcaatgcgcctccggcaatgaaaccggatgccagcaacgtacctttttcacctctttccgtattgagtgccgtatccttgctgcggcttgttacataccagttgacggcaccgcctactaccagcggcacattcagctccaacggaataaacatacccagcgcaaaggccagtgcgggaatcttgaagaatgtcagcacgatagcaaggattgcaccgatgccatacagcagccagggggcacctacgccgctcatcagcggttcgataacggcagccatcgcattggcctgtggtgcagccagtgcgccgctggtgaagccgtatgtcttgttcagtataatcattacaccgcctactgtagcagcagaaacgatggttcccaagaatttccatgtttcctgtttggcaggcgtactacccagccagtaaccgatcttcaagtcggtgatgaaaccgcccgccatagacagtgccgtacatactacgccacccatcacaagtgcggccaccatgcccgaaggacctttcagtccgacagctaccatcactacggaagccagaatcagtgtcatcaatgtcattcccgataccggattggtgcctacaatggcaatcgcattggcagctaccgttgtgaacaggaaggaaatgcctgctaccagcgcaatcgctaccagcgtatggacgatatttccctgcatgatatcgaagtagaagaacagcacgatcagaatcagcgtaaggatagagccgatagcgatgattttcatcgaaagatcacgctgtgtacgcacgatattcttttctacattgcctttaccgcccatttctttggcagccagtccgacggcactcttgatgattccccatgaacggatgataccgatgacacccgccatggcaataccgccgataccgatgctcttggcgtaatacttgaagatttcttcgggactcatcatgcctaccgtagacgtgatttcgggattccatgcgttcagcacgctgtctccccagatggcggacattcccggaatgatgatccaccatactgccagtgatccggcacagatgatggaagcatatttcagtccgacgatatagcccagaccgagtacggcagctcccgtatttactttgaataccagtttcgctttctcagccagcatttctccggctccgcatacgcgggtggtgaagttctcgttccaccagccgaaagtggccacgatgaagtcatacaatccaccgatcattcccgccatcaacagcggtttggcctggctgccgctcttttctccggacaccagcacctgtgtggtagcggttgcttcggggaaaggatatttgccgtgcatatcgctgacgaaatatttgcggaaaggaatcagaaacaggatacccagtacgccacccagcagcgagctgataaatacctgcataaagctgactgtcatctcaggatatttgacttgaaggatataaagggcggggagggtaaagatggctccggcaacgattacaccggaacacgctccgatagactggataattacattttctcctaacgcattttttcttttggctgcaccggagactcctacggcaatgatggctatcggaatagcggcttcgaatacttgtcccactttcagccctagataggcggcggctgccgagaaaaggatggccatggcgataccccatgttactgaccagaagtttacttccggataatttttggaaggactcatcaggggattgtacacttctcctgcttttaactctctgaacgcgttctcgggtagtccggtgaatttgtcttcttcttgtttcatattatatttttagtagtttatgcttaatggacttcaaagtaaacaaaaaaaaaggagaatcgaaagattctcctttacgttatgtctattttttcttacttctcgtctttcggggtcatatcgccttcgatatagagacgtaccatttcagtttttgcgttggtacgcagggtaatcgactttttgaagtgtcccggatatttgcctgttccgttgtaagttactttgattgtacctttctttcccggctggatcggttctttggtatattcgggcactgtacatccgcaagatgctaccgcctgatgaattactaaaggagcgtcaccgatattagtgaaagtgaatacgcagcttactaccggactgttttcagagaactttccaaagtcgtgtgttgttttgtcaaacttgatatcagcgttagtctgggcaaaagcgaaacttactcctaccactaacaaggtcattaaaaaaagtatctttttcatttttccttctttttattgattacaaacgccaaaggtaacgtttttccctgaaactatcccgtcggcagagttaattttatcgaaaaagggaataaaataacttctgtttatcatcgtccttgggcttggcaatcctgaccaccgaggtggggaacactgagcgccgagctgaatgagagtaagcagcgaggcgaaaaacgctgagcaccgagacgagcagaagtgagcaccgaggtgaatactgccgatctctgttcgctaaattaattcatttcagcacgctaatgaatactcatattttttgtttatcgcataaaaaattactatatttggaacaaacccataaaatccagctattatgaaaacaaaacttgatttctatcatatgactcccttttatgagttgaattactttatagcatttattgttaagttgtacaaacgcattcaacaacgtagagaacagagagaacatcgaatcaaagatgaactggtctgattcatttctgttctgaaagtgaatcggcggcggcgaaattctttcttctctttcttagtaattctatttctttagaatagaattatatactctactcttctctactggttaggtttcggtttccctttcggttaggattcggttttcgagccctgccagaaggcgtttcagaactttgggttttgcaaataaaacactattttttcaacccgaatcccagcatcatcccgtcgtagttttcagccagtgagctgacagttttcagtgctgtgctgtttgtcttgctgccgaggaatgtcattaatttaagcagcttgtcggagttgaacaataaatccatagagttggaagtgcagttcactttcgcatgcagattcagcagtttcaagtactttaagtctacctgcttggtggaagcattgtacgaataagtgccgctcagtttcttttttccgacggtgctggtgaaagtactgtcggcgttgaacgtgaagctcatttgtccttctttgatgcccactttactcaattgctcgttcaatttgttttctgccatcgtggcggctgcggctcctcctgctttcatcagcagattgtccgattcaaattctactgccgaaccgctgtaagtccatgtacctgtcatgtctatcgtttcgggtgtcccggtgatggcatttactactttggagatgttgtctttgttgagcagatcctttaatgattgtgcctgactgttgcttgcaaagagtgagaataatgcaacccatgcaataaataaaatgttctttttcattttcgtttacttatttttatagacttctttactgatgttttctatgtagtcgaggatttccgtgcgtcctgtgcggttttccgaagaagatatgaaatacgggggaagttcttcccattccttgctcagttcacgcaggtagttgttgatattcattttcagacgtccgcctttcagtttgtctgctttggtgaagatgatggagaaagggatgccgttttcgcccagccattccataaattccaagtctattttctgcggttccaggcgactgtctatcagtacaaacaggttggtcatctgttcccgttcgaggatgtagtcttcgatgatggtacgtatctggtcttttcctttttgtccgcgtctggcgtagccgtatccgggaagatcgaccaggtaccagctttggttgatcaggaagtggttgataagcattgtctttcccggtgtggcagaggtcatcgccagtcctttgcgggcagtcagcatattgataaggctcgactttcctacattcgaccgcccgatgaaggcgtattcgggaaatactccagtcggacatttcttcacgtccgtgttgctaatcacaaattctgcactcgttatttccattttattgtcatttatttctttgtttttctacttctaataaactctcttatcgtttataataaactatggtcacgtttataataaactccactactttttattataaactccggacgcctgttttcaaggcgtttccaccgttttctcttttccggacagcagcatgagccccgcaaaggtaaggcttccgttcaacattagcaattcatagccaaatttatatccggtttctttgtttatccaccagtccagagcgtagcagagcaccggagaggcgatggcgatgagcgggaccagccggtccttagtccggcgccgggtgaacagtccgaaggcgaacatacccagcaagggcccgtatgtgtaggaggcgatgatgtagatcgcgtcaatcacgcttttgttgttcagcatctccaccaggcagataaagaaagccagcaggatggagagggacaggtgtactttctttcttttgcggcgggctgtttcttccgtgtccttgtccgtgttcagcaggtctatacatacgctggtggtcatggcggtcagcgcggagtctgagttgctgaaagctgcggcgatgatgccgatggtaaaaagaatcagtaccgactgtcccagatatccttgtgtggcaaacatgggaaggatatcatcattcatggccggtagttccagttgcatttgtcccgctaatgcgatcagcagaatgcctaggcacagaaacaggaaattcagcgggatgaatgagaatccgtagcagtacatattctttttggcttcgtgcagattgcggcaggagaggttcttttgcatcatgtcctgatcgagtccggtcatgacgatgacgataaagatgccgctgaagaactgtttgaagaagttctgacgggacatccagtcatcgaatacgaagatgcggctgtgttcgctgtggcggatggtctgtacgatgccgtcgaagcctacatccagcttctgtatggtgaagtagatgatgaatagcagggctgcgatcaggcagaatgtttgcagggtgtccgtccatacgattgtcttgatgccgcttttgtgggtgtatatccacacgagggccacggagccgacggcaatcacccagaaagggacgtgcatatcctgaaatacgtgcgtatgcaggatcagacagacgagatatagtttggctgccgttcccagcatacgggagagcaggaagaagaaagagccggtgcggtaggcattcacgccgatgcgtgtaccgaggtatccgtagatacttgtcagattcagcctgtagtaaagaggcagcaatatgtgtgctacgatcatatagccgaagaagaatccgaatacggtctgcatatacgtcatgtccattccgcgaaccatgcccggtacggatacgaaagtcacgccggaaattgtagcgccaatcatgccgaaggagactatataccagggtgatttgttttctcctttaaagaacgctgcatttgatccgcctttatgtccggtgatgtgggctattaacaacaagcccgcaaaatagcatataataatgactaatatcatcatatcggctgcaaaggtaatactttctttgtattaaaaacaataatccgtatctttgcgcccgaaacagatagaatttcattcgtaatctatgaaccaacaatatccttccgtactgctcgaaaaggcagtaggcgaattttccaaacttccgggcatcgggcgcaagacggcaatgcggcttgtattacatctgctccggcaggacacggctactgtggaggcattcggcaactccatcattacgctgaaacgtgaagtaaagtactgtaaagtatgtcataatatatctgataccgagacttgtcagatttgtgccaatccgcagcgtgacgcctctactgtctgtgtggtagagaatatccgcgatgtgatggcggtagaagccacccagcagtatcggggactttaccacgtactgggcggagtgatctcgccaatggacggggtaggaccgagcgacctgcaaatagaaagtctcgtacagcgggtatccgaaggaggaatcaaggaagtcatcctcgctttgagcaccacgatggaaggagataccaccaacttctacatctaccgtaaactggagaagatgggggtcaaactcagcgtaatagcacggggcatctccgttggcgacgaactggaatatgccgatgagatcacgctgggacgcagtattgtcaaccggactctttttaccggaaccgtataatctaacttaattatttgaacgaatatcgtaactaacatggaagaacagataaaacgcgcagtgagaaatttgaatatcagttatgttttcttttgggtgcttcccgcctttttgcttggggcaggggagttcgaccttcttcctgtgggagctttggtcgataacccacaggccacctattatttggagacggcaggcatcctgctgaccgccttgtgtgtgccgcttgccttgaaactgttcagtctggtactgaaaaagaagatagacctcctgacgattcctcttgcattgaagcgttatgtgcagtggagcatggtacgcctcggattgctcgaagtggccatcgtcctcaacgtattgtgctattatctgacccttagcaacaccggaaatctctgtatgctgattgggctgaccgcttcccttttctgtctgcccagcgagaaaagacttcgtaacgaactccatattaataaagaataagccggtatgaaacagtcttttttaagtaatgaccgcatctatcttcgtgcggtagagccggaagatatggatgtgatgtatgagatggagaatgacccttccatgtgggatatcagtaattttaccgttccttattcccgctacgtgctgcggcaatatatagagggttcccagtgtgatgtgtttgccgacaagcagttgcgcctgatgataatgagcaagtccgatcatcgggtattggggacgattgatatcacggattttgtgcctctccactctcgtggcgaggtcggcattgccgttcacaaggactatcgccggcaaggttacgcttcggacgcattgcagttgctgtgcgagtatgctttcgatttcttgtcgctgactcagctttatgcgcatgtggctacggacaatgaagtctgtatgaaactgtttacttcctgcggtttcgtccaatgcggactgttgaaggattggttacaggtcggtggatgttacaaagatgctgctatcttccagtatctgaatccgaagagacattaattgaaagtcggcacttgcggaaagcgtgaccaggtttcatacttgctgcctagtttctccaaggcttgtttccacatatccttggtgtctccgttcatcagataggcattctcttctttggagacgagccatgtgttctctttgagttcggtgctcagttgttcactttcccagccggagtatcccaggaagaagcggatgtagcggtctactttgtttccttgcagtatgtatttctttatctcatcaaagtcaccgttcagatacagtcctttgctgataggtatggcacccggaatgtctgccagtgtatgaaggtagaacagggtatctgtagcgataggtccgcctttgtataaaggtatattttcgatatacttgaattctttgataatgtcgttgacaaatatcggcagttgtttgttgataatcagccccatgctgccttcttcggtatggtcgatcaacagaactacagatctgccgaatgtggcatcacgaaggaaaggttcggagatgagaatctttcctcgtgatggcaatacattattcgattgaattttaaatatgtcagagtctatattcatgccatcagattgatattcgtgccactaatataagaaaagaaatggaataatagccatactttcccattttttttgttttaagagcagcttttatgaatatccgcatctgacatgaacatcagttccggcataaatacgctattcggctgtcaggcaatcgggtgatgttcggcaaacagcttcattctttcgtcgagctgtgcgtactggtggtctttaataaaagaggtacacgcgcgtaatccttcctggtggcttccggtggtgaccagtgaaatggcgctcactccatagtacatcagttctttggcaagttcgccgcttgtcattcccggatagccgatggtgaagtaaaatccgtcggcaatcggatcgcccaagtcattgtcatataccagatagaatccgtgacggaggaaaatctcttttaacttctgcgctctgtcaccatataccttcacttcgctgaggaagttgtattgaccttcattggcagctttcagcatggcagccatcgcatactgtgcggagtggcttgtgccggaagacagtgcatagagtacgcggtggatgaagaccgtgccgaatgttcccccgccataacgcttcgtcagtccgggatagctgcggtgatacaacttatcggaaatgcagctcacgccgatacgttgtccggcatagctgaaggctttggaaccggaaatcagcaacacataattatctgtgtagtgagctaccgaaggctggaacggagcttgataaggagtgctcagatcctgacggaaatccattgcaaagtatgccaggtcttccagtacgattacgtcatattgggtggcaagttcgccgatgatgcgcaactcttcgtctttcaggcaaatccagctcgggttattggggtttgagtagataatagccgatatatttccttttctcagatagctttccagcttttctttcagcttgtcaccgcggtagtcgtagacatcaaatgtctcatacttttgtcccatcactaccaactgctgtttctgtacgggaaatcccggatcgataaacaggatcgtgtctttcttttcatcgcactggctgcaagtaaggaacgaagcgaatgttccctgcatagagccggtaacgggtacgcatccctccgggcttaaatctacattgatgaatgctttgataaagtcggacgcttcttttttgagttccggcaatccgttgatatcgggatacaggctggcaattccgttttgcagcgcttcgatttccgcttttactcctacggcagaggccggaagtcccggaacacccatttccatcttgataaattcaacgcctgatactgcttccgcctttgaagctatcgctttcacttcacggatagtagccttcgaaaagtcgacaatttgaaactcattaatcgtttcgtcaatcacatttcgttcgattggtgtatttttcattctattttctatttatagtaatgcttgcaaatgtacatgataattcttaataaacacactttttcagaaaaaagatactcttgctattgtaggtttcaaaaaaatgtctacctttgcatccgcaatcgagagagatgcgaattaaaaaggaaattttggtgcgttagttcagttggttagaatacatgcctgtcacgcatggggtcacgggttcgagtcccgtacgcaccgcttcttttgatttttataattaggaaaagctctggttcttaacgggatcggagcttttcttattaatcttactgagtgaaaaagcaattgattgggaatatgaatattgagacatgcagaattaactctgctgaaatttaataatttagccaaagttttaaaggagctattttgtcacggctgacaattatcttatctttaaaaggcggctttacatgtaagattgcttttcccagaaaatatgactcaacctttacgatggcattgatgctaactactgtttgacgattgcttcggaaaaaaacatccggatcgagttgttccataagcttgtctaaagaaaggtcaatgataaattctctattttgcttggttacggcaaaggttactttattttctgaataaaaataagcaatgtcttccacttgtaaggtaaaaagtttgtcatcgcctgagattaggaaacgggtacggtatttctttcccggttgggtgatgttttgtaaaatttccattaagtcaattggcttttgcccctgattcaggtatttggtagtcagatgttcgaactttacaattgcttcttccagtcggatgttatcaatcggcttaagtaaataatcgatactgttgactgtaaatgcccgaatggcatattcatcatacgcagtggtgaaaatgatagtactttctggttgtgcctgttcgatgaatgtgaatgaaatgccgtctgtcaattgtatgtcgagaaaaacaagatccggatggggattttccgcaaaccattctacactcttctttacactaccgggcaatactgtaatttgccattcggggcgtaactcatttaatgtattgtttaaccgacgggcggccggaatttcgtcttcaataatgactgctgtaattttattcattcagtactgggattttaacggtaaaataattcgtattattttctatggtaatatcctgattgcatatcaggaggtaacgggctgaaagattctttaatcccatgccggtgctgaccacattgggctttatcctgattttgttggttaccaatattcttccattctcagaatcataatcgatcaaaatattcattggcatatccatattaattatattatgcttaatgacattttctaccaatagctgcagggttaatgaggggagtttcaaatcataattatcagcttctattctattctctatccggatgcagtctcctaaacggactttatgaagaaaaatataagagtcgatgaaagagagttcggattctatagtaaccagacgctgttgctggctttgtaatatatatcggtatacatcagacaaacgttgggtaaatagaattgcgtttttgggagcatactctatttcggatataagtgtattgagactgttgaagagaaaatgaggattcagctgattttgcaaagctgcatactgtgccttaatggaattctcttcgacttgttccgttctttcgtgcagaagaactagctgcctgtaaaaattgatagtcaaagtaaggttggttattaccatttctaccagccagactaaggctatcattctcagcccggaccctttcagagtaaatggtgcaggaacctcaaatatggctttgactattgacaagaccagataattcattaaaaacagaataattgccgtcagaatgcaatcgataatcaatcgctcttttcgtttgaccagaaactgaaagcttcgcttttgccagttgtggatcattaatactccgaaaccgactagattaaaggcggcaagtatcaggataaatgacttgaaagaaatcagtacttccagatgttgcggggtgaagtcggaataaagcaagagaaacagatatgagaaaaatgccaatcctgagaatagcaaaccaataaacagataattgaacttttgccgcatattgaacgtagactttatatattacaaatttaacaaaaaaacaagaggtcgccaaaagtaactataacattttgtacttcctcttgtctttttgagagaatctagatcatgtcagaaacaaacacctaagcggaatccaatattattatttccatcctgacaaccggtcagcaactcgcttttgttggtggcataactataatatgcagccagatggaaaccaaatcggctttgggaaaacggataaatgttcactccaatttctggagagacatagaacccccagggtttatctgtcagacttatagtgttcagatatgttgtattttgggcatacatggttcctatcttggtgccaacataaggtttcaggcatccattgctgataaatcggtatgaagcggcaagcccgaatggtagctggaaagccgactcttgtcggtcagtagtcaacgaagcagtaccttcagttatggtttgacgcggaacatatttatgatttgtatggaaatcaaggaaagcccccagactccagtgtggagtaaggaaataacctccttccaggttcataccccaaccactgattttatcggcaaaattcgtattgagaggagcattcatctgccagtctacattaaaatgcaatctatcgctgatatcctgtgcataactactgaaataaaacaggcccgatatcatgaatgccagaatatactttttcttcggaataaattttattgttttcataattttgctttttaggatttcttgatataaggagattggtcaaacgcttgattgaccgcatccaacgttagttgcatgttatatttggaattctcaaataatagtccggttgcgtatgaatgccagattaccggtaactttactttctgacttgtatcctcgggatggtctgtcaaatttaccatttccattatcaatgttcctgtattataactataagttacaggatacggataataccagtcgttccaatatggtccccaataaccgggtccccaccagccgttataccatccgcctccataccatccgccggttcctattatttgggttgtttggcgcgtgaaagagagctgtaacccaatgttagcattcttaatcactttaacccttgtataaccacgggtatccatctcatcagcaacctgcttaataatttcttgtgcattctcatccttccaatactccgccttcattccctgtcctatcagtagaatactatcgggcaaacaataagttttgaaatcattgaaattagttttgctgtcataattggtgtaaactgtgaaattattgtcaagcttacttaaatccggatctttttcacacgaagtggcaagtactgccattaatcctataaacagatactttttcatattctttcttttaagtgttaaaccatagttgtttttaatttaatgcctatagtcagctaaaatattttaacttgtttatttactaaacacacattttttaccttagagtgaattgcctttgaatacattggccttagccattgggagtaaacttcctgttaatgaaaagttgtttgaattgaagttcggacttatgtctaccgatgcgttattacttcctttattcaagcggatgttcacctgtgctgatattccgactcccattacgttcatcgaaacggatatattaccttttttgtcggtagtctgcttatatccggatatattcccgttgacagtaatgccgcctagaccgttgggaccgctgatcggaatattgaaggctacctgaaccacagctttattaccttttaccgctacaaaatttgtattgggagaaacgaaagctgtggtaccatatttaaacataacatgatctgcttccaaaatgaagtttttcatttctatagcttgtttagcttcatcgaaaaacatttggtcgagtaattcttgttcagcttttttttgtttgcgggattcttctttgacagtttgtgcctgaatgtttcccatgctaatgaataatagcaacattgataagattgataactttttcataattgtactttttgagttatactttttcttttctttggttcaaagatagtgcgccgattttattttcttccggttttttttactgaatcgtaaacggcaatttcccaactgtagatatggtgtgctgagccgtgaagagtctgtttttggataccattcagcagataattgatgctattcaggtttgccgtttcgttagttggatacatacgtactgctatatcgttgagatctgtattgaggtcggtacaagtgatgtaacgaaattttcttgatagaatcgtgaagagaattaccgatcagttacggctatacccaattgaaaaaaatagtctttgtttccgtttccggaagcaaaaagggattgttttttataagtataatggaaataggtataataaaaagtttcatgtggaaaataatgaagagactttactggaaagggaaagaaggattgagaaaatattgcagggacaaggaagaaaccatattgctttgtataaagtaatcggctgtcggaacataaaaatacgattggattaatgcactcatcagatggtgggagaattggaaataattatgaaacaagagggggaattgctaaaaaataaattttttacgcatgctttgtgctgaaacgaggaaattttacctatttttgtctgtctatttttgaatgctatgatacaggtaatacaattaaaaggaaaagacaaacatttatatcagcttttggcgcctctagtaatggatccggatgtaatacgtgcaaataataactatccgttcaagacaagcgaagattttgtttggtacattgcgattgataacagagatgtgataggctttattccggttgaacagaaaagcgggaaaaaggctgtcattaataattattatgtagctgcggtggacgagaaacgaaaagagatcttgtcgcttctgctatcttctgtagtcacggcatttatacctgcgggttggacgcttaactctgtcacgctgatacaagatcaggaaacttttgagaaattcgagtttgcatctatggacaagaagtggacacgctatgtaaaaatgaacagatgaattatgggaaaaaaaacaatcacaggaacaaaaaatgtatatgaattagcacaagagcgactgaaagtaatatttaacgagtttgataatatttatgtatctttctcgggaggaaaggatagtggggttctgctgaatatgtgtatcgactacatcaggcggaataatctgaaaatacgtttgggagtgtttcacatggactatgagattcaatacaagatgactatcgactatgtggacaggatactggaggcgaacaaggacatcctggatgtataccgtgtgtgcgtgcctttccgggtatctacgtgtacatctatgtaccagtccttctggcggccctgggaggataacaagaaagatatctgggtacgctccatgcctaagaaggccatgaagaaggaggattttcctttttacaatacgaccatgtgggattatgaattccagatgcgttttgcgcagtggctccatcagaaaaaggatgcggtacgcacctgctgtctgatcggtatccgtacgcaggaaagttttaaccgctggcgatgtatctatatgagccgcaaattccagatgtatcataagtatagatggacttcaaaggtcggaaatgacatctataatgcctatcccatcttcgactggaagacgacggatgtgtggacggcaaacggaaaattccagtgggactataatgtactgtatgacctgtattatcgtgccggagtcaatctggaacgtcaacgggtagcaagcccgttcatcaatgaagcgcaggagagtctggcgctctaccgggtgcttgaccctaacacctgggggaagatgataggacgggtgaatggcgtgaacttcaccggtatgtatggaggcacgcacgctatgggatggcagatggtgaaacttccggaagggtacacctggagggagtttatgtacttcctgctctctaccttgccggaacgggcccgaaaggggtatctgcgtaaactgtctgtcagtgtacatttttggcgaaccaaaggaggctgtctgagtgattccaccattcagaaactgattgatgccaaagtgccgattatcgtgatggacaatagcaactataagacatacaagaagccggtgcgcatggaatatcaggatgatatcgatattccggaatttagggaaataccgacttacaagcgtatgtgtatctgtatcctcaagaatgaccatgcctgcaaatacatgggattctcgccgaccaaagaggagatgagtaagagaagtcaagttatggaacaatatagaatcatagtatcatgagtgtagataaaagtccggtctacgaggtgaaagcagtgcccgtagaaaaagtattagcgaacgattataacccgaatgtcgtagctcctcccgaaatgaagttactggagctttcgatctgggaagacggttttacaatgccttgtgtatgttattacaataaagaggaagataattatatcctcgtagatggttatcaccgatatacggtattgaagacatcgaaacggatttataagcgtgagaacggattgcttccgattgtggtgatcgataaggatttgtccaatcgtatgagctctaccatccggcacaaccgtgcccgtgggatgcataatattgagctgatgtgtaacattgtagcagaattggacagagccggcatgtccgaccagtggattatgaaaaatatcggaatggatcgggatgaactgctgcgtttgaagcagatttcgggactggcggatttgtttgccaaccgggagtttagtatcccggatgaggtggcacctacggagacagaacgtaaaacactctgatttttcacctgtatcatagtatataacatagccctcggatgagattatccgggggcttgttttattatggaatttatttatattaattcacactaaaagtttcgaatgctgaaacttttgtcttttttttattctaatagtgcaaaatgcctgttttactactccttatttttagatttcgcaatattccattcggacgacctctttattagccatataagataactttcattgtctgtatgagaaatgaatgaaattcgcagagtcatgcaatatcccgacatttgcattatgagattttgactgattacagattaaggcttgactaagtaccaatgtcaggtaaatacgaatgtttaatgagattagagggatttaaagtgaatattgggttgttcaaccttttattattagtagctatattatcttgtatggatgatactttcactaataatactactgctaaagggacatttatttcgatcagaggaatagatgttcagagctgtacacatctagtcaatccggaaacgtatgattttgtattttttgccaatgaaccgtattatattcccgtaataaaccaattgaattatattactgcttatgataatctgaatgatattgtgtattcagaacgctattccttgtccgaacaattaattccgatgatacaggaggttaattatcaatacgttgcgtgaaaagatgaagaaaatgatgaaatatataatgaagatatttggtctggtgatcatcttactgatatccgcctgtgagcatgaaacattgttgacgggagagccggatgatccgggagatatttcggaagacaaggtacggcttgagatttttgcacgggcgaattcataccgcctgccttcgaccagggcactaggggatgaaaatacggtcgaaatgactccctgggtactcgtgttcagagggagtggcacaggggctatttttgtagaagctgtgcaggccttcgagtttgcaggaaagcgatatgtccttttaactaagcggactgatggaagtaagtaccagttgctgatattagctaatccgatggctcagttttattacggaaatgcttctacgggatatgttttcaatgagtcacaacttactgagaagttgattgagggaacaactaccctggctactgcatgtacgaacttgctgacggagccggcaagtacttctcctgcccgcatcccgttcagcggtgtggatgagacgataccgatgagttatttgctggaagtagataaggtggataatacaacgaagatagaaaagagtgacgggagttcgttgatgcttcttcgggcggttgccaaaatcgtggttgttaatgaagcatcgaactttgaactggaaggagtgtctgctgtggcaaacgttccgcgacaggggcagttgcataaccttatccctgcttctattatgggcaatgctggtaatttgacgaattatcaatacgatgcttcatgctcgttgcctttggtgtcagcagaaacgataaccaataaacaaagtaccgaaaacagtcctatttatatctatgaaaccaatacccagacttatagtacatatctgatcattcagggaatttatgaaactaaaagctattattacaaaatggcgatagtagataaggatctgaactatatgaatatatatcggaatcatgcgtatacttttacaataaagaaagtgcatggacgggggtatgataccgtagcggatgcaaagctttctaaaccgtcgaatacggatctggattttgaaattacagtggacgacagtaattcttatgagattatagctaacaatgattattatctgggtgtgagtaattctgtctttatagcttattctccggatgatgcgagtacttatgaggcttttaaagtgataacggattgtgaaaaagcttttccggatgcgcgtacaataaccgacaatatggccgaagctgataattcgtttgcgctaagcagtcccgctgacggaaaattgcctatagtagcaagcacttctccacgtgtcactccggtcagtgtattgatacaaagctggctgatgtatagtgaagtggggcagagttttgagggaagagataaagtgaatgcatatataacattaaaacttggaaatttggaaaaacaggttcatatcagacgaagagcggctattgatgccggcggtaccatacttaaatacatgcctgccaatagttatccgtttccgacgactggtgaggtggattatcattgccttaccggggaggtggaagatggtactgacaatcctaaggaatggataaaattactgccatcttcgatggtggacagaaatgatacggataaaatcatagtggaagacgggcatatctatattaaaataatgcctaatacggcttcaacaacgagaaacggtatcgtgtatctgacaacaattatgcccggtagtttatatacaggtgaaagtacggtgaagcgtatcaaaattgatatcactcaaaagggtaattaataaacgtaagataaatgaagaaagttagtatactcatagtattggtgctcggatgttttatcgagagtaaagctcagaaagttgcgcttaaaagcaaccttctatatgacgctacgactaccatgaatctcgggctggaattcggactggcacgtaagtggacgctggacgttccggtgaactataatccctggaagccggacaacggaagacgtctgcgccattggggaatacagccggaagtccgctactggttttgtgagaggttcagacgtacgttcatcggagtgcatggacattatgcggacttcaatgtcggtgggttcccggactggtcgtttattagtgagaatatgcagaacagccgctatcagggatatctgtatggcgggggtgtttccgtcggtcattcatggattctgaagaaacgctggagcatcgaagcatcggtaggagtggggtatgcacatattgtatatgacaaatatccgtgcagggcgtgtggtaccaaactgaaagacagcagtaaaaactatttcggtcccaccaaagcgagtgtgtcacttatttacgtaattaaataaagtagaatagaatgatgaacagaagtatacaattcatcgtgtgtgtattggctatcttatgtcagaatataaattcggcagttgcccagacacgctcttatgacggggttatctctgtagtaccggtacagttggaacagcgcggtaaatcggtttatataaatattgacttcgttctggaggatgtaaaggtcaaatcggcacacggagtggattttattccgcaactggttgctcctgcacatacttacaatcttccgaaagtatccatcaagggacataatgaatacctggcgtatgaacgctggctttcattgatgagtgcgaaggagaaggatagctacgaaaaaccttatgtggtggaaaagggtagcaagaaaagaaatgatacgattcgatacagatatatattgccttacgaatcgtggatggacgatgcccgggtggacgtacagcgcgacgaatgcggctgcggtgaaattcagctgatggatgtggaaccacttggggatattgaactggaacgtatattagtaccttacgtggtaacacctttctttgcctatttgcagcctaaagcggaagaagtgaagagccgtgatatacaggcggaatgtttcctcgacttcgaggtgaacaagattaatattcgtccggaatatatgaataacccgaaggagctggctaagatccgtgcgatgattgatgaattgaagtctgatcctagtatcaaggtaaacaaattggatattgtaggctatgcttcacctgaaggatcattggcaaataacaaacgtctgtccgaaggacgtgcgatggcgctacgtgattatctggcatccagatacgatttctcgagaaatcagtattttatcatctttggtggtgaaaactgggatggactggtgaaggcgctggatacgattgattttgaatataaagatgaagcgctgaatattatcaatgatatccctgttgaaaaaggtagggaagctaagttgatgcagcttcgtggcggagtaccttatcgatatatgttgaaatatatattcccaagtcttcgtgtggctatttgtaaggtgaattatgagattaagaactttaatctggacgaagcgaaagagatcataaagacacgtcctcagaatctgagcctgaatgaaatgtttatggttgccaacagctatccgaagggttctcaggaattcatcgatgtgttcgagactgcggtccggatgtatccgaaggatgagatcgccagtattaatgctgccgctgctgctctttcgcgtaatgacttggtatctgcggaacgctatctgaatatggtaaatgtcaataagcagctgcctgagtatagcaatgctatgggtgtattaatgttattaaaaggagagtatgaacatgcggaagaatatttgaaagccgcagccaaatcgggtctgcaagctgccggacagaatttggaggaactggctaagaaaaaaacgaatgcagctgaaatagaaaagaaaaaaagaaaatagagataaataaactagttacaaacgcttttattaatttgtaaaaacaatgaaaaagaagaattttcttatgttagcttttgctgctgtggcttttgctgcttgtagtaacgaagatttagtgccgactgggaatccaggtgatgataatcaattggtgacagacccgacaggagacgcatgggtggcattagctgtaaagactccggtacaaactcgtggattgcataacccgaatcaggaagctgcaacagaggacgaatcaaaaatcactacagtgcgtgccatattctttacggcaaatgcgaatgaggatgctgcaactgtaactgctgacttgacattggataatgacgaagctggtcttgatgccaatggtattcctagtggggctgcaggtaaggcttttaaagtccctgcaacttctaaacgaatattgattattgcgaatccatctcctaaatttgaagcaaagactgctagtgagacagatcaaaaatggcctgttggaacgacttatgcaacagtaaatgcagctcttgacgatacttcggcttctatgacaactgctggtaaatttatgatgtctaacgccaaaggttcgttagaaccttcagatgaagatgaagcttcaggaacatttggtgctcctgtcgatttggctctttatgcaactgagacagcagctactaataatccaatatctatcagaattgaccgtgttgtatcaaaagttcgtgtatatgttactgctgattctgatgcaaaggcaactatttcggatgcgggatgggtgttgaatgctactaacaagacattcttccctgtatctaagagaacgttgacttggaatgagactcctgctaataaacctttaggtgctcgtggtacatgtattactccgtttgaccagtataagatcggttcatacagagttgaccctaactatagtactcaagctttggctaactataatgcttataccagtacttcagctccttcaatttggaatgatcctacaactacggtgaataaagttgctgaatattgtcttgaaaatacgcagactgcaactcataatgtacatgcttatactacacatgtactgttgaaggctaaattcattccgtctgaatatggcagacctgcgccaaatgatggtactccatctacagctcaggaaacagatccgaaacttgtcggtgactggatgttaatcaatggtggcttctatacttttgctacattaatggagtggattgaggcagaattgaaagctaaatatgctgataaagagcctactaccttcccgactgctcgtactactgcgtataatagatatttagctgctgttggtgtaggtgaaattagccttcctgctacagctgatgctgcagctattaccagtcttgttgacgattttaaagcaacaaaagctaatgtaggaaatgttgcagctaaagacagagctataactgtaacaggtcttacttattatgtaggtgctgtaagttactacaaaattatgatcaaacatgatgataccagtgctgtaacaaatgaattaggtgaatttggagttgttcgtaactctgtttacgatatcaatgttaagaagtttaacaatccaggatatccggctattccggatccggacgaaggaacgccggatgagagtgacgaaggctggttgtctattgaaattatacctaatccttggacttggtatactcaagaggaaattatgtaattcggaattagtaatagaaatagatttttcaaataaaagttgtgggagaaactctcccacaactttactcccaatattttcaaagttgccgaaaactttttaaaatttcgggatattacttttgatggaatcaataaagtattctatcctctgaattaggaaataacgagaaaagagattatttcttttcctctatatataattgaaaaaaaggaaaatatgaatctaaaaagccttatatgttacgttgccttaggtattctgttgatgagttccgggatagtagcttcatgcgacagctttaatgaagacctgccggaatgccgcttgtcagtgaagttcaagtatgactataacatggagtttgcggatgcgtttcatgctcaggtagataaagtagaactttatgtatttgataagaatgggaaatatctgtttaaacaagctgaagagggaagtgcattgtctaccggcaattatctgatggaagttgaacttcctgtcggacaatatcagtttatggcatgggccggtgcacgtgattcatatgatatcacttcattgacacctggtgtctctactcttacggatttaaaattgaaactaaaacgtgaagcctctctcatcatcaataaaaggatggaaacgctctggtatggtgaagtcatcaatgtcaacttcgatgggaccgtccaccagactgagacgataaatctgatcagagatacaaaaatcgtacgatttggcttccagtcttatacaggcagctggacactggatatgaatgactatgactatgagattatagaatctaatggacatctgggacatgataattcattactggatgatgatgtgttgagtttccgaccttactatatggaacagaaggatcctgcgactgcctatgtagacatgaatacaatgaggctgatggaagaccggaaaactcgtttggtgcttactgaaaaagcatccggaaagagagtgttcgatataaatctgattgattatcttgctatgaccaatgcggagggtaaaaatctgagcacacaagaatatctggatcgacagagcaactatcatataatctttttcttgtctgaatcatggcttgctgtacagattgttgtcaatggatgggtgcatcgcattcaggaagagaatcaatagaatgatctaagaatagtggggaactattattagtgggacaggataaatagtaatatcctgaagggagaacagcccgggtcgataatgatccgggctgtttgtactttagagagtatcaatcactgtacgttgcttttgcaggaactcgatacgctgggcttctccactttctgaaattagtgtggaatgtcgtttcaatgattgaatccagttccgctgtatctgacagatttgcggactttgcgaatccatcgaattgatggaatacacccggagcaaactgacttggtagtcttgtttctctatgtaggtgtaagtcgcttcgaaatcaatgtttgagagatagaaagagacttttcgcccctcactgaattctcccttaacagatagtgtctccatgactgaaagcaattggtagagttcatctttcaggtgtgccacgtcgtcttccgtaatcagattcagacttgcgaaatacttgatctctttgacaaaggaaagaaagatgttgctatcccagataaaataggtcttccgacattgctttacactttcactcagcttattatgcgctttcacgattctgtcttctacctgcatctctgccagtgagttcggtgttttcatttgcccgttctgataaatccatcggcaaaggcggaacttagacatgtattcgtaagatgaataaagagtgaagggaagaagattggaagctgtatatacttccgtcgtatcgtctcctttcacataatcgaatatctgctgataacggctgataatctcataataactttctaaagtgttgggcgaatgcagcaggttcatatcaaaagtaactctattggaaaggtggttacctataatctgatcaatagaaatccccagttttttagacagaagggctacttcgtcgatagtaaaagctacttcaccccgtagtctgcgatagacggcttctttacccatatacaaaatgtctgccagagaattggcaagattttgtcctttggggatccgttctttcattgcagtaatcaactcgtttacaataccatttttcattgtttgttctcttttatatacgttaatactttatgtgatacattctatgcaaaattacggcatgtaaacgagagttttgtgtgggaaaacagttctgaagagtaagagctttttctcatttgatagaatagagatagaaaaagaacgtataatggaaaaaagtaggcaataagcttgtctactttcatgatttggaattataaaattcagttagtttcgattatcgaaattaggaagaactctatagagcatcaatgatttcgcgctgttgattaaagaattggatgcgttgcatctcaccactttctgagatgagtgtagagaatttctttaatgactgaatccattctttcagactttgaaacatctgaacgtcctgtgtagtgagtgaattaatggaataaacacgtatcagactaagttgtagtgtacttgtctcgagataactgtaagtcgcctcgaagttgatttgtgacacataaatatgcacatcattaccaaagtctgtctttccttttatagcaagcctttccaactcatctgtaagtatcagcaattcttctttcagattttgcttcatttcgtctgaaatgagatgtatgtcggaaaaatactgtatatcattgataagatgaagaaaaaccatgctgtcccaaatgtaatcggtagaatgaatatgatgcgaaagtttcgcaaaatcttgctggacattgattatcttttgaggaatctccagttcttcgaaatgtttgcacttaatatgttcattctgatacatccacttgaagaaacggaacttggccagaagttcgtgcttcagatatagtgtctgcggaattacattggaggctgtacctaatgaggcattcggatcttcccgcagcgtatggaataacttgacgtgcttgttgaggaaatcatagtaagtttcgaaggggttgccatgatctactacattgatatcgaacattgcattgttgctgaagctaactccggcaattctgtccagggatatccccagttcttttgaaataatggctgcttcctgaaatgtaaaggggacttcgccacgcagcctccggtagatagcttccttacccatataaagggtatccattaatatatttgccaattgtccttttgcagggaacttttctttggccgcttctatcaggtttgtattaagttcattcattatcataatcctattgaattagtggtttgtttctattaataacacttgacacaggaaagttgtttcggaaactgaaactattttatttttgcttttcttaaaaaatatccacctttaaaattgtatattatgagcaaatcgtttacatttgcctctataaacaagacggggaagttctcttctctgaaaaacaatagttaaaattagaagatgaaaagaatattggtaagtggcggggctggatttataggctcgcatctttgtactcgacttgtaaatgagggacacgacgttatatgtttggataacttctttacaggttctaaggacaatataaagcatttgatgggaaatcatcattttgaagttgtaagacacgacgttacttatccttattctgccgaagtggatgaaatttacaatctggcttgtccggcgtcacccattcattaccaacatgatccgattcaaactgccaaaacatctgtgatgggggctatcaatatgctcggactggcgatgagactggatgccaaaatactgcaagcctccactagcgaagtgtatggtgatccaattattcatcctcagccggaaagctattggggaaatgtgaatccggtaggttatcgctcatgttatgatgaaggaaagagatgtgctgaaaccttgtttatggattactaccgccagaatcagactcgcatcaagatcattcgtatctttaatacttatggtccgagaatgcttcctaatgatggtcgtgtggtctcaaactttatcatacaggcgctgaataatgaagatatcacgatatatggtgatgggaaacagacacgcagttttcagtatatcgatgacctgatagaaggaatggtgcggatgatggatacggaggatgactttacgggtccgataaatattggaaatccgaatgagtttccggttcttgaattggcggaaagagtgatccggatgactggctctacttcgaagatagtttttaaacctctgccgaccgatgatccgaaacagcgtcagccggatataaaactggcaaaagagaaactgggatggcagcctaccgtcgagctggaagatgggctgaagcgtatgattgagtatttaaaaaatgtctgatgtaacataaaaaatagaatgatatgaatgtggaaattaatccttccgaatataaggtccttattgtggacgacgtaatttcaaatgtccttctgctgaaggtgcttctgaccaatgagaagttcaatattgtaacagcaggcaatggaactcaggctttggagcaggtgaagaaagaaaaacctgatcttgtgttgctggatgtgatgatgccggatatcagcggtttcgaagtagcccagcaaatgaaggccgatgaagaaatgagcgaaattccagtgatctttcttactgctttgaatagtacggcggatatcgtgaaaggatttcaggtgggcggtaacgattttatttccaaaccgtttaataaagaggaactgattattcgtgtaacgcatcagatctcgttggtggcagccaaacgaattatcatagcacaaacagaagagttgcgcaagactatcataggacgtgataaactctactctgtgattgcacacgacctgcgttcgcctatgggctctattaagatggtgctcaatatgctgattctgaacttaccgagtgaaactatcggctctgaaatgtatgaactgctgacaatggccaatcagacaacagaggatgtattttccttactcgacaacttattgaagtggacgaagagtcagattggtaagctgaaagttgtttaccagaatatcgatatggtagaagtagtggaaggagtgagcgagatctttacaatggtagccgggctgaagaatatccacattgctgtggaaatacctgaagatcgtatggaagtacgtgcggatattgatatgattaagacagttatccgtaacttgataagtaatgcaatcaagttcagtaacgagggatcggaagtcttggtatcactgagagaagaagatagcatggcgatagttagcgtgaaggatagcgggtgtggtattgatgaagaaaatcagaagaaattgttgcataccgatacgcatttcagtactttcggtacaaataatgaagaaggttcaggactcggactgctgctctgtaaggactttgttactaagaacggaggtgagctctggttcacttcgaagaaaggagaaggttctacgttcagtttctcgattccgttgttggaaagctaatataagttcgatataagataaaaacctgtcctgttttctaagcacattactttagagaagtagtgacagctcagaataacaggacaggttttgtttgatagttataaattattctttcagcattttatcgtttacaaatggctttaaaatcacaataagcacatttctttgtatcttctgtctgtgtgaaaggctcattctcatcgaatatttcttttaatagtctttgcagacgttctcggaattcatcttcaaaaaaggcaaagttgttgaccggaatcttcggttggcgtggctctcccatttcaatgacgggcgaatagctttcagaggctgcccgatggatgtagagaagggaaggagctactttcagagactgctgccggctcataatggcagcatacaggaaagtctggaagatatagttgggacgcgtttccgacggagtaaacagttgctcgatgttggcaggcgtcttggggcttcctccggttttatagtctacaatacgcagggtggtgtctttggcatccatacgatcgatggttcctcccaatcggagggtgatcggaccttgaccggtctgaatcgttatcttttcggcaacaggtttttccatggcgaccatttcgaagggggcgtattgcaggtcattcctcagcagttgtttcagataggagacgattactttggagttgatgagttgtacgccattatattcgggcttttcgtctgccggaaccttgaaaagctcttgcttgaaagcgaggtcaacatagttttgtagtttgacttcgttgcgcagcaagcgttccaactcttctttttgtattattttcctgttagcggtcaggtctgtataagctaattgggcggagaggtggaagatggttccgaacaatgcggagtcgatttccgcactgacttcgtccggtgcttttagtctggctacataacggtaatagaatttcagccggcaatcgagataggcgttgagggctgaaggagaaagtatatacgattggggattcgaacagtcataagagcagcgaagtcgttcgaatacttccggagttttctctatgctgatatctgttgtaccttgaggagattgtccggcttcaagatattcgcgggtaatcttgtgaggcccttctacaagcaattgtaacatgaaacgggattcttctccacggttcagcccattggaagaagtgttgtaaagcaaggtgatgttttccgcccgttgtatcagtcggtagaaataataggcatagaccgcatttttgtgttcgatggtggtcataccgaaagctttccggaggttatagggaataaaggaagaatcacctcctgatttaggcaattgtccttcgttgagagagagaaggatgatattgcgaaagtcaaggttacgggtttccagtactcccatgacttgcataccaatggcaggttcaccatggaaaggaatgttggaggcggtcagcactttgctgaccaggcgtcttagtgtgtcggtgcgtacattcagctctccggtttctatcaggctatagagacggttgatggtggtatagctcttgaagagggattcccggtaaagttggttgaagatatcgttgtactcgctttcttcccgatagagaagggagatgtctttgattaattcggtcaggtagtcgcatagctccttgatgccgcttcggggagtgaaaagtttgattaggaaatcatccattttcagttctgaagggagcgggtagaagcggttagtcttggtcagttcccgttccagaggttcagcgttgatggatagctgacgggtatatgggtgcttcagtatagcggatacggtttcgtaggtgaaacgtccggtagcggtacggtagccgttcgtttgtaattccatagcggcattaataaagctgtataccggagtttgtgcaagcgggaaacccatcgtgatgttgacgttcttcacttcttgcgggatggagtggagtacgggaagcagcagggcttcgttgcagaggactacggcgttctctttttcttcgttggcagtggaaagagtactttgtacccattccggaagaaagcgggcttgcgcgttctcggtagaagcggagatatagcgtatgttcttcggcttccgtagagtgtcgaaacaactttcgggcaattcattcgggaatcgtttcagattacggttgatgaattctccggcttcgtgtttggctatttgcttggtataaaagagatcgtaatcccagtagaacatggctttatccgcatcttgtaatagctggaagaatttggtctctactttattgagcacgttgaagccgacaaagatgtatttgtcatatttcagtcgggtggtatcgagttgctcgattacattgcgatagagcattccttcgtaggctattccgagttccgctaagttttcacggtagcggtggtagatggtacccagtttgtcccaaagggagataaacttctctttgagtacggtacggcgctcgatagagaagttttggaagaactgttggattgcttcttcctgctctttatcaaggaattcgtaatcgtccatcagattcttcaggtcctgcaagttactgaagagtttgtccgcatctaccaggtttttatctacatcgtcgaaatcgctgatgagcagctcgccccaaaaatagaagtcgtccagtgtttcctgactttctgtttcttcacggaatactttatatagttcgcagaccaaccggatagggtcacccgctttctgtacagataacttccggaacaggtcgctgatactcattgcggcaggagaccagatcggttggtcggattctcctgccagatattcgttgaagaataagttggcacgcttgttagggaagacgagtactgtacgggacagatcgtttcctatcttggtatataaatcatgagcgactagttggagaaatgattgcatatcagttataagttttttctatcttagatatttgtttattgttgcctgaacattacagggattgtgaagcggacggcaactttcgttccgtcatccagttctcccggtttccatttaggcataagaccgacaatacgtaatgcttctttatctaaatatggatctacactacgtaccactttaggttgaataatattcccttctttgtcaacgataaatcgaacgatgacgcgaccttgtcccatgtctccttgggctatttcgggatattctatgtttgcactaatgaatttcattagttcttgtgctcctcccggaaattcgggcatgacagcagctacttctaatacgtcggtaagcgagtctttttcagtaagcgagtcttttactgttattatttcgcctgatataggggtaatctcaattaatcccatgtcttggggtagttcaggtaattcttgtttgtttactgtatctttctctaccataggtatagtatcctctacaggagtcgggcatacttctccaaacattacacttgcattggtagagtcactgatagtttcctgactagtccctttattaggagaactactacatgaagtcattggtgccattgctaccagtccggcagatatacctaatatagttatggcttttccagccatccgtttacgttccagctgttgttccagataacgtacttcggcttcgcacttgggacaagtgcctagacagtcaccttgatattgacactcggaagtaataaactcaatatcattagcttctgctatttgtctgcggatatccttcaatatcctgcaggtttgttttcctcgtttcatggctgacaattattaggtgttttataagtaaaccgatcgaattgggtgattcccatttctttcagtaaacggatgctataatcgacgtcgttctctgtattgtatgcgggaatgacgggggtacgaacaatgatttgttcgttttttccgtgatcaatcaaatattgaagattatgcaggactttttcattgtcttttccggtgtacttttggtatatggcattattaatgtctttgatatcgatgatataagaatcaacaacaggtactagtttctctatattctcttgtgctacattgagtgacgtttctacggaaagctgccattcctgtccacagagttgacggaattcatcaatgaaatcgctctgtaaacaaggttctccgcctccgaatgtaatgcctccgtgagtagcgagaaaatataactcatcctgtttgacttcctcataaagctgcccgcagtcatagtgcttccatatatcttctgagtgtagagattgcggattgaggcaatatttgcagcgcagcgggcaaccatggaaggccactagagtagtgactccctctccatcagtactgagccgatggcggctaattcctatgagcggtgcggctttcattatttcacttttacaattagctcttcatctacgtaccacaggtagccggtgatatttttatatcccatcttagtaagcagttgcatatatccttttacctgtttgttatattggaggttctctttaccgaatttgaagtcaactacaactacttgaccgtctttcatcattacacggtcgggacgtcgggtttgcaacacccctttttctttgtaaatgatggcacattcgttgaacagggtccattcccccgaataccagtcttgaatctccggggaggagaatgcttttcgggctacttcccgtatttcttcggccttttcgctgctggcgatgaccccttcgaaaatgaggcgctcaatagccggatcaatatcttctgctgtttctatggcagaaaatagcgtgtgcagcatacgtccgcgatgaatgaaacggtcatccgattcttcttcctcgatcccctgaatgaaatcggcggagcggttggattgacggaattcaatctcatgacgcatggactccatgtggacaggcaacttatccggcttctgagtcagtttattggtcgaagtttttgctttttcttcttccgaaggacagagttctccttgttcatagcaatcttcctcccagtcgaggccttctttgagggcaactacaggcagtgtattggccaacagttcggacatagttcctttttgtcctttcttgctccagatgatcagattctttccggcacgggtgaaggctacataaagcaggttgagattgtccacccacagttgaagacgttccagcagataatcgttcccatagatggattcggccatttgtgtcgagtaattgatgggaaggatatccatggcattgaacggagcttcctgaggggcacaccataccagttggttattcgtttcattctccagtttccagtcgcagaagggaaggagtactgtatgaaattccaatcctttggatttgtggatggagaagattcggataccttccacttcaccgctgggaatggttttgctgcacagcgtctcatcccagtagcggataaaaccgtcgagctccgaggagttactttgcaaataatccgttacggcatcgaagaaggcaaacagataggcatcctgttcttcaatgtgactcatttcgaagatgctgaatagttcttccagcaattcgtagagaggcataagacggagttctttctgcttttcaagaaatgcgggcggcagatagttttctatcggaaggagcagaagggtgttccagtccagattcttttgcagaacttcgttctgataggctattgccagttgggcccgtgcaattttattgctctcgtcggatagaaatcgcagtgcgtctatcatcatgcagatggcaagagaggcatcgaggcggaaggcttcgtctgatacaattttataatgtaactctttgtcgaagtagtccgcgatgcggggaatacttttgttcttgcgtacaaggatagctatgtcattcagccgtacaccggaagaaagcagatgctctacttcttcaccgagacttatcagcgtctggtctgtatagtcatgcgcttcgtccggttccagaaaagtggctttgacatatcctttctgtacacttcgcggagattcctgtaccacatcggcataggctttctgaagatcatcgcaatctttgcccaactgttttttgtatacttcgttcaggtaatttacggcagcagtgaatatttggttgttgaaccggatgatattggtctcacttctccggttggtggctaaggtctttaccttgatggggaaatgctcgatgcggtcgttcagaccgttaaggattccccagtcaccgtttcgccagcggtagatggactgtttgacgtctcctactatcaggctgtctgctccttgtgaaagcccttcgagcaggagcagtttgaaatttccccattgcatccggctggtgtcttgaaactcgtcgatcatgacattgcggatgttggttcctatcttttcgaacacgaaagaggaatctccgtccttaaccagttgatggagcagggcattggtatctgataaaaggaaccggttgttgtcatggttcagctgtcgcacttcttcgtcgatattggcgagaagctgtaccttgttgagatgctgcagggaaagccggcaactatttagcaggagattgtttttagaacgcagcttctccgcatcctccagtatctgcatcaggctggatttcgcaagatcaataatatcggcaaaccgtggagatgttttagtagcccagtgtttggcatcttccaggcatttctctacagtggcattgcggatgtcattacttagaatgccattgttcagcttacggaaatagctgccgattccccgtgaaccgttttttagttcatctgcggtaagggcgtgtccttccagttctccttcaaactggtcatagaatcctttcatttgctccaggatttctgtttccaaagctttcagctgcttgcggtattctttgatggtatccggattgcggaggcgctggcggagaccttcacctttttctatatatccttcgtcgaagatgttgcgcccgaaatttttgacttcatccgatacattccagcgtttgtcatcagctattcgttcgttgatgtagtctaacagccatgcgaggacaggagaggtgggacccagtttctcaatcatgctgtccaccgcatcactgagtacttccgcattgttcagttcgatattcagattcggactgagttccagctcacgagccagattgcgcatgacggactggaaaaaagaatcgatggtttctacacggaaacgactgtagtcgtgcagcatatatccgagggcgattcctgcggcttcccgtatttcctgttctgtcctctttgtttcttctttgatgcggttcaggtaggcctcggaatctttgtcaccgatctgaatgccgtatagctgactgagaatacgttccttcatttctgctgttgccttattggtaaaggtaacagcgagaatctgtcggtaggcacgtggattcagtaccagcaactttatgtattccactgcaagggtaaaggttttgcctgaacctgccgaggctttatagactaggagttcactcatgcttttgatatgaattgtttcatgattgtttgaatatgtcaagcccgaaataaagaataaataaaggcaaatagtcttttagggcaatgcgtaatagctttaaagcctgtccgatacgatagttaacggtttggggagagacgttcagcttttctgcaatttctttatgggtcatccggtgattacgattcatttcgtatgcttcccgataatctttgggaagctgtttcagagcattctcataaaggcggaacaactcattttccagataaaagtcaggattgtcgaattctttctcgaatttttctgtaatctcctgatgtacttttcgtctgatctcgaaatgggaaatacggttcagagctttgtttttgacaatagtaaagagaagcgttttcaatgtaagctcttccataaggttacagcggttttcccataaccacatcatcgtgtcctgtacaatctcctcaatctcctcctgctcgctgacatattgcgaacaaaaggcgcacaatctacggaaataatgcctgtagacagcgtcgaatacatattcttcgcctgctttcaaggcattgatgatagatttattattgttaatatctaggtatataggaggttgttgcattcttcattattttttatgcagagcaaaaataatgaaagcaatgaaagaaacgaaataaaacgggagaaaatatttttttcttttttagtttagtatatttgcgctgccaactgtattaataacagaggtattatatttttgatgaatgtccgcatgctgccaaattagcaaagtttaaaccgccaagatgtccgaaagtcgtgttttggaacacttttttttgcatagtcttttttctggcaaagatcgagacttaaagatacaaagacaacgggtactttatcgggggcttacatagatgtgaagttcttgtaatagcatagtgttttatcttaatatataatatatggaagaaaaagacaaaataatcgcatcactccggcaacaactccggaaagtcctgcgagaaaacagagttcaaaagcaagaaattgctctcttaaatcatgagttagaaagggctaaaatgaagcccccaaaagagcgttctttgaactatctttgaaatggttagctcgcatcattataattgactgatatgtagctgaatatcctttattatcacgccgctttgggagcagggggtcgtgggttcgaatcccgctaccccgacgaaaaaaaagagttacattaagtagctcttttttttgtttatgcaaaaatattatttcaaatgcaaatagtattcacgagtcaattctttatactcttcactatattgatgacgggctacttcagtcaacagttcctccttaatacatccctcattattaaacgtaaaagtaattaacatccgtttaggagttcctcccggcttggttattacatttagctggcgagttgcatataaatgatattcggaagctgcagtcttcaccctgtcagccacgtctgtcggtattacgattgtaaaagtaccctctttcttcaataaatcagccacacccttcagcaacttttcataagtcagagaatcgttatgtcgtgccatgcttctctgttggtccggacaactaagcgaatccacaaagtaaggaggattggaaacgatcacatcaaatttatccggagactgatagaacagaaaatcttgcttcaccacttctatccgatccttccagggagaacgggccacattttccttagcctgcccggcagcggcttcgtcaatttccagcgccacaatatttgcatccggcagactacgttgagccagcatcaaagcaaccaaccccgtcccggttccaatatctaaaattcgatgtgccccttgaacagaagcccacgcccctaaaagtaccccatccgtacctaccttcatggcacatttgtcatgccatactgtaaactgcttaaactgaaagaaaggattcgccatcttattagccatctaaacctgttttttactgatctttgccgaaaaccgtcaaaaataaataattattatggaataaatccattaacgcccgatattttggcattgtttttgtgtttttattccacactgtgctttattattaaagagaatcaattaactttgcaaacgatttatgcatattatgtatgacataaactaaattaaaacgaaaagatgaaagaaagatacttattggaagaagaagttggtgagaacggcttctcactgattaccgactatgatggcaatgacgaacatgtgtttgatgtgaatataaaatccggtgatattcttccggttctcccccttcgtaatatggtgttgtttcccggagtatttttacctattacagtaggcagaaaggcttcattaaagctggttcgcgaagctgaaaagaaacacaaagatattgcagtgatttgccagagatcggcacacacggaagaccccaaactggaagatttgcacaatgtcggcactgtcggacgaattgtacgggtactggaaatgcctgaccagacaacaacagtcatccttcagggaatgaaacgtctgcgtctgaaagatattgtagatacacacccttatctgaagggcgaggtcgaacttttggaagaagatgtcccaaacaaagacgataaagagtttcaagccctggttgaaacatgcaaggacttgacgatgcgttatatcaaatcatcagaaatgcatcaggactcgtcatttgctataaaaaacatcagtaatccgatgttcctcattaatttcatttgtgccaacctgccattcaagaaagatgagaagatggatttattaagtatcaactcattaagagagcgtacttatcatctattggaaatcttgaatcgcgaagtacagctggcagaaatcaaggcatccatccaaatgcgtgcccgtgaggatatcgatcagcaacagcgtgaatacttcctccaacaacagatcaaaacgatccaggatgaactgggtggcagcggtcaggagcaggaaattgaagaaatgcgcctgaaagcagttaaaatgcactggaatgcagaagtaagagatactttcctgaaggaactggcgaaactggaacgtacacatccgcaatcaccggacttcagcgtacaactcaactatctgcaaacaatgctcaacctgccttggggtgtttatacaacagacaatctgaatttgaaaaatgcagaaaagacgttgaataaagaccactacggactggaaaaagtaaaagaacgtattctggaacaccttgccgtattaaaactgaaaggcgatatgaaatcacctattatctgtttgtacggccctccgggagttggtaaaacatccctcggaaaatccatcgcatcggcactgaaacgaaaatatgtccgtatgtctttgggtggtgtgcacgatgaagcagaaattcgcggtcaccgcaaaacttatattggcgctatgcccggacgaatcatcaagagtctgattaaggcaggagcctctaatcctgtatttatactggatgagatcgacaaagtcagtgccgaccgtcaaggcgatccgtcatcagctttgctggaagtacttgatccggaacagaatacctctttccatgataacttcctggatgtagattatgacctttccaaagtactgttcattgcaaccgccaataatctgaatacgatccccggcccgttgctcgaccgtatggagctgattgaagtcagcggatacatcacggaagaaaaagttgaaattgcccgtaagcacctgttgccgaaagaactggaagcaaacggacttaaaaagacggatatcaagattccgaaagatactttggaagcgattatcgaatcatatacccgtgaaagcggcgtccgtgaactggaaaagaaaatcggcaagattctccgcaaatctgcccgtcaatatgcaacagacggttatttcgccaaatcagaaattaaaccgactgatttgtatgaattcctgggagcaccggagtatactcgtgacaaatatcagggaaatgactatgcaggcgtagtcaccggactggcatggactgccgtcggcggtgaaatactctttgtagaaacgagtctgagccgtggtaaaggtgcgcgtcttacactaacaggtaatttgggagatgtaatgaaagaatcagctatgctggcactcgaatacatcaaagcacatgcttccatcctcgatctgaatgaagacatctttgacaactggaatatacatatccatgtccccgaaggtgctattccgaaagatggaccgtcggcaggtattactatggctacttctttagcttctgccctcacccaaagaaaggtaaaagcaaaccttgccatgacgggagaaatcactctccgtggcaaagtgcttcctgtcggtggtatcaaagagaagattcttgccgccaaacgtgccggaatcaaagaaatcatcatgagtgccgaaaataaaaagaacatagatgaaattcaggacatatatttaaaaggactgcaattccactatgtaaacgacattaaagaagtattcgcaatcgccttgacaaacgagaaagttgcggatgccattgatttatctgtaaagaaacccagccaggaatgacatttgagttacaatatacagacactaaaagtaatgcccgtgcaggtctgataacaacagaccacgggcagatacaaacacctatcttcatgcctgtgggaacactgggcactgttaaaggagtacatgtaacagaactgaaagaagatatccaggcacagattattctgggcaacacctatcatttatacttgcgtccgggactagacgtaattgaaaaggcaggcggactgcatcgcttcaatggttttgatcgtcctatgctgaccgatagcggtggttttcaggtattctcattagcaggaatacgaaaacttcgggaagaaggagccgaattccgctcgcacattgatggcagcaaacatatctttaccccggaaaaggtgatggatatagaacgtaccattggcgctgatatcatgatggcttttgacgaatgtcctccgggagattcagattatgcatatgccaaaaagtcattagggctgacacacagatggcttgatcgttgtattcagcgttttaacgaaactgaaccgaaatacggctacaaccagtctctcttccccatcgtgcaaggatgtgtttatcaggatttgcgtaagcaatccgctgaattcgtcgcctccaaaggagcggatggaaatgcaatcggcggactggccgtaggcgaaccggtagataagatgtacgagatgatagaggttgtcaacgagattcttcccaaagacaagccccgctatctgatgggagtcggtacccccgtaaatatccttgaaggcattgaacgcggagtcgatatgttcgactgtgttatgcctacccgaaacggacgaaatggcatgctgtttaccaaagacggtatcatcaatatgcgaaacaagaaatgggaaacagacttctctcccatcgaggcagacggtgcttctgctgtagacacgctatacagcaaagcgtacttgcgtcaccttttccacgcacaagaactactggcaatgcaaattgcttctatacacaatctggcattttacctgtggctggtaggtgaagcccggaaacatatcattgccggagatttctctacctggaagccgatgatggtaaaaagagtgtcaacaagattataaagaatgaaaagcaatcgattaataaaacggctggattggtatatcatcaagaaattcttggggacatacgtatttgccattgcattgattatctcaattgcggtggtattcgacttcaacgagaagatggacaagctgatggagcatgaagccccttgggacaagatcatctttgaatactacatgaacttcatcccctacttctccaatctgttcagtccgctgttcgtattcatcgccgttatcttctttacctccaaactggcggagaactctgagatcattgccatgttctccaccggtatgagtttcaaaagaatgatgcgcccctatatgatctctgccgccatcattgctgcaacaacattcatgatgagttcgttcatcattcccaaaggtagtgttacccgtctgaactttgaagataaatacatcaaacccaagaaagtcaactcggtccgaaacgtgcagttggaagtggacagtggtgtcatagcctatatcgataattacaatgacggaatgaaaaccggcaaccgcttttcattggataagtttgtcgacaagaaacttgtctcccacttaacggcacgccgtatcacttacgatacaacaacggtcaataaatggaccattcacgactatatggtacgtgaactggacggactaaaagaaaagatcaccaaaggagaccggatcgactctattataaatatggacccatcggacttcctgatcatgaagaatcaacaggagatgctgaccagtccggaactgagcgaatatatagaaaagcagaaacgacggggatttgccaatatcaaagagtttgaaattgagtaccacaaacgaattgcaatgtcatttgcttcgtttattctgacaatcatcggggtttctctttcatcacgaaaaacgaagggtggtatgggacttcatctgggtattggattagggcttagcttctcttatatcctgttccagacaatcacttctacctttgccataaacggtaacgtgcctcctgcgattgcagtctggattcccaatatcctctatgcaggcatcgcattctatctgtatcagaaagcacctaaataaggaaacataaaacttagattcaggagataaaaaatagaagttccgcctattcttgccgaaagcaagtacaggcggaacttttttgttgtatccatttcctcttttgtctattctccattttaatcaccaaacggtgatccggaaaatccctctttctccttactcttttcgagattgtcaaccaatctcacttacataagcagaaagatctgcagcagagatgtttttggctataatcacaccatttccatccaataaatagtttgtgaacccccgattcaaacggtactttttaaataatccggagtcctcgccttctgtttccacgaaacaagtgggcgtaactatttggtccttacgaacggtttccttaaagattgactggtattcgtcaaacgaaacagaaaccatttccacattacgggaagaacgaagcacattgctcaaacttacgttttgcatccgggattgcgcgtcataacttgcccaaaaactaagcaacacatatttacctttcaaattacccaacttaaatgccggttgcccattcgacgcagattcgattttaaaatcaggggctacgtcaccctcactcaaacctccggtaggtttgtctttctcaacgaaagcggtcaaggaacaaatcagtaatacaacaaaaatccattttacataagaattcatgtaatgcggttttagttaatactatccgggactgtccttaaacagtggtttcttcccgaaacgttgtcttttcaggcatcaggcgaagaggaatccgctgattatcagtgcctttaattttgaaaccgggtgcaaaggtaagtaattattaaattaacttccaaaaaaacaagccattttcttacttttggggtataactttttatgttatttagcataaaaacgaacttttttccctacttttgcagcgttaaagtctatttttttatgcaaccatcaaatactgaattgattctgattcgagttaccggcgaagatcgcccgggacttaccgcttccgtaactgaaatacttgccaagtatgacgctactatccttgatatcggacaggcggacatccataatactttgtcgttaggcatccttttcagaagcgaagaaaggcattctggattcattatgaaggagctgctgtttaaggcatcttcattgggagtaaccattcgtttcgaaccgataggaaccgatcagtatgagaactgggtaggtatgcaggggaaaaaccgctatatactgacggtattgggccgcaaactgtccgcccgccagatctctgccgctacccgcgtactagcagaacaagacttaaacattgatgccatcaaacgtctgacggggcgtatccctttggatgaggacaaaacggatacccgtacccgtgcctgtatcgagttctccgtacgcggtaccccgaaagaccgtatcgccatgcaggagcgactgatgcagctggctagcgaacaggagatggacttttctttccagcaagataatatgtaccgccgtatgcgtcgtctgatctgtttcgatatggattctaccttgatcgaaactgaggtaatcgacgagctggctatccgtgcaggtgtaggcgatgaagtaaaggccattacagaaagcgccatgcgtggagaaatagactttacagaaagcttcacacgtcgtgtagccttgttaaaaggactggatgaatcagtcatgcaggaaatagcagaaagccttcctattacggaaggagtagaccgcctgatgtatgtactgaaaaaatatggatacaaaattgctattctttccggaggattcacctatttcggtcagtatctgcaaaagaaatacggcatagattacgtatatgcgaacgaattggaaattgtagacggcaaattaaccggacgctatctgggagacgtagtagacggcaaacgaaaagccgaactcctccgtctgatcgctcaggtagagaaggttgatattgctcagacgatagccgttggagacggtgccaacgaccttcctatgctgggaatcgccggactgggaatcgccttccacgcaaagcccaaagtagtggcaaatgccaaacaatccatcaataccatcgggcttgacggagtgctctatttcctgggattcaaagattcttatttgaatatgtaattgagaccaaaaattattttatctttgtcggcaaataaaaagaagtaatgaagttttccgaactaaaactaaatgcaaatgtgcttgatgcgcttgacgccatgcgatttgacgagtgcacgcctatacaggaacaagcaattccaatcatactagaaggtaaagatttgatagcagttgcacaaacgggcactggtaaaacagcagcattcctgctgcctatcctgaataagttatccgaaggaggacatcccgaagatgccattaactgtgtcattatgtcccctacccgggaattggcgcagcaaatcgaccagcaaatggaaggcttctcctattttatgcccgcatcgagtgttgccgtatacggtggaaatgacggaatccttttcgaacaacagaagaagggacttacgttaggtgcagatgtagtaatagctactcccggacggctgatagcccatttaagccttggatacgtagatctttccaaggtttcttattttatactggacgaagcagaccgtatgcttgatatgggattctacgaagatatcatgcaaatcgtgaaatatttgccgaaagaacgacagacaatcatgttctcggcaactatgcctgccaaaatacagcaactggcaaaaacaattctgaataatccggcggaaatcaaacttgccgtttcaagaccggcagataaaatcattcaggcagcttatgtatgttacgagaatcagaagctaggtatcatacgcagcctttttactgacgaagtacccgaacgtgtgattattttcgcttcctccaaaatcaaggttaaagaagtaacaaaggctctgaaaatgatgaaactgaatgtaggagaaatgcattcggatcttgaacaggcacaacgtgaagtggtcatgcacgaatttaaagccggaagaatcaatattctggttgctacggatatcgttgctcgtggtatcgatattgacgacatccgattggttatcaactttgatgtcccccatgacagcgaggattatgtgcaccgtatcggacgtacagcacgtgccaacaatgacggagtagcactcacctttatcagcgagaaagaacagagcaacttcaaatccatcgagaactttcttgaaaaagaaatatataaaattcccgttcccgccgaattaggagaagcaccggaatacaagccccgctcttacaacaataagagaggtgacagttctaaaagaagaagcttcggaggaaaaaggaataacaacaatggaaaaaaaggcaataaccgcccctcttctcctgcaagaaactaaaaaacatttggctatttcgtcggagtaatagtcaacttgccgctaaaactgacagtcaaatttgctatactgtaaatagaactttccggaatggataaaacagcctgataatggaaaccattccggtctacctttacaaatttagtatcagataaaattgcctgcaccaggaaatccgcaggaaccacactttcaaacatctgcttggtaatatcactggcaaacaggctcttcttgccttcatacacacaaatgtgcatcacattatcgtagtacacattatccatactaataccgtcttcagtatatatcgtcttgatcaccctcattttggatggattgatatacacataagcacgatagcggctaccattatagttcacaatactatcgcgcttcgttacttccgtataggtgggaataatcatttcctgaccgacaaaagataacgaatcattaggatcttcagatttatgcaatctgatcatattatctgcaatcgaatgaaaccagaaaatatgctccccctgcttatctatcttataataggtagtatcattgccataagtataaagagtatcccgtataattttgaatgtaataggagcgctctgcgaatctgcataatagatggtatccccttctatacgcatcaacgggctctcagtctcatcatccagccagattccttgcagcagttctttcgcactcaaatcctcctcttgtccggaggaagagtgcggattcttactgctgttacatgctgcgagcaagatcgctactaacgatatcgctacatatttcgtcatttgtctaaattttgtgtataaagatactctaattatcttatttaccaatgcatgaataaataaatccgagctcttccatttcttttttatcatagatattgcgtccatccaacacaatttgctgattcatagtctttttgatgacagcccatgaaggcagacggaattctttccattcggtaattaacatcaggacatcagcatcaagtaccgcatcatacatatcgcgggcgtaataaataacatcaccgatacgacgtttacactcattcattgcagccggatcatatgcgcgtatctgacaacctgctttcagaagtttatcgatcaataccaatcccggagcctcacgcatatcatccgtttccggtttaaaagccaatccccacaaggcgatggtcttacctctcaaatcaccattaaactgcttcatcagtttttcaaacaagactcctttctgcgcctcattcacatcttccaccgcacgaagtacacgcatagtatacccgttttgctcggcagtcttgatcaatgctttcacatctttaggaaaacaagagccaccatatccgatacctgggtataggaacttgcgtccgatacgagtatcagaaccgataccgctacgtaccatatttacgtcggcacctaccagttcacacaagttcgcgatgtcattcataaagctgatacgggttgccaacatagagttagccgcatatttcgtcatttcagccgatgggatatccatgaaaataacacggaagttattcaataaaaacggcttatagagtttcgacatcagtttctccgcacgaacagactccactcctaccactacacggtccggactcataaagtcgctgatagcattgccctctttcagaaattccggattggaagccacatcaaactcaatgttcactcctcttttatccagttcttcctgtatagcggcacgaactctgcgcgcagtacctacaggaaccgtgctcttcgtcactaccaatttatattgattcatattacgaccgatggtgcgggcaacttccagcacataactcaaatcagcactgccatcttcgtccggaggcgtaccgacagcactaaatataacctcaacatcgtccaggcaactctcaagcgaagtcgtgaatttcagtctttttgccttgacattgcgaagtaccatttcttccaatccattctcatagatcggaatcattcctttctgcaaagattctattttctcgctattcgtatctacacaagttacatttacgccaatttcagcaaaacatgttccagttaccaaaccaacataaccggttccgacaatcgctattttcatatctatcgtttgttagagtttattcaaaatatacagcatctctgaaagccatgccctctttatccttgggcgacaaaagcatctgcgactccccaagcatccagtcgatgcctaacgtttcatcattatatactatagacgcttccgcttgcggagcatatttattgtctaccttatacatgaacacaacttcttcgctcaacaccacaaagccatgagcaaaaccacggggaataaaaaactgccttttattttcttcactgagcaatgcgctgacatgttttccaaaagtcggtgacgaccggcgcaaatcgacagcaacatccagcacctttcctttcagaacgcgaactaactttgcctggctgtattcacccttctgatagtgcagtccccgcaatacgccaaaggacgatttcgattcattatcctgcacaaagtctaccggaccgatcttcgcttcaaactcctctttcttaaaggcttccataaagtagccccgttcatcagaataaacattgggttctatcagccacaccccatctatttctgtctgtatatagttcatcgttagtagtaataagtaaaacgatgcaaaagtagtgattttttcgaagttttctgggatatattcaattaatctcttaattttgcactatgattgaattagcacaacacatagaggctctgttgttagagaacgattgcgtaatcgttcctaattttggcggattcgtagcacactacgctcccgcaacctatgtaaaagaagaaaatctttttttacctcctacccgtatcatcggtttcaattctcagcttaaactgaatgacggcgtgttggtacagtcctatatgtctgcgcatgacaccagttttgccgatgctacccgtatggtggagaaagaggtgaacgcattcgtcgagattcttcatgaagaaggtaaagccgatctggaaaacgtaggtgaaatccgttataacatttacggaaactacgaattcactccttatgatcataagataacgactccttcattatatggactggattcttttgagatgcgtgagctctctgcgttgcagcgaaaagaaagaatactggtacctgccagtctgacgaaagaaaagaaaacgtatgaaatcagcatcagccgtacccttcttcgtaatgctgcggcaatgattgccgttatcgttatgttcttcgcattctctactcctgtagaaaatacgtatgtcgagaagaacaattatgcccagctgctgcctgccgagctttttgagcaaatagaaaaacaatcagttgcagtcactcctgtttctgtagagacaaagcataatcaaaagaatgcgactggtcagacgaagaaagttaccgcagataaagccagaacttcaagacctatcgctgtcaaagaagtcaaggttgccaagcaggaaacaacaccggccgcaccgacagcaacaataccgactacgaccgcagtgacaactccggttgcacccgcagttcagccacaggccaatcatccctttcacattatcgtagcaggaggaatcggtctgaaagatgctgaagcaatggcagaacaattaaaggcaaaaggatttgccgaagcgaaagccttgaacagcgatggcaaagtacgtgtcagcatccgttcattcggaaatcgcgaagaagctaccaaacaactactggagcttagaaaaaacgaaacttataagaatgcctggttactggcaaaataaatccccttttgaaacatgaaacgagttctttgtcctaaatgtgagaattaccttttttttgatgaaactaaatacagcgaaggtcaatcgcttgtattcgaatgcgaacattgtggcaaacaattcagcatccgtctcggaaaaagcaaagtaaaagcccttagaaaggaagagaacctggaagaagaagcggaggttcataaagaagaattcggttatattacggttattgaaaacgtgtttggtttcaaacaagtacttccgttgcaagaaggtgataatgtgataggccgtcgttgcgtgggtaccgttatcaatactccgatcgaaagcggtgacatgagtatggacagacgccactgcatcattaatgtgaagcgtaacaaacagggaaagcttgtctacacattacgggacgcccccagcctcacaggtacctttctcatgaatgagattctgggagataaagaccgcgtccgcatggaagacggagcaatcgtaactatcggagctaccacattcattcttcatacagctgaagctgaatagaaagaaaactgtttttctcctttctatcagaactatctttgatatcatatatacacataaaaacagcgtcaccattcacaacgaacagtgacgctgtttttatatgatattacttacttaaaggataccctttaccgtttcaagcatacctttctcctgaatagaatccagatcagcctttacagctgctgccagtcccggaatcttattcaaatcttcgccccagataaactctgctgccagtacaccttcggtaaccttcttcgtgcaaccggtagcccaaagctctttcagcaagttcatgatttcaggagcatcgttcggtacaatttcagccccgtctgcacgtacaccacctttataataagtgataatagcagccaatccgagtaccagtcctttcggcagttcccctttacgttccagataagtcttcaatcccggaagatcacgagtttcatatttcgggaatgagttaagcataatgcttgttaccgcatgatcgacgaatggattgttgaaacgttccaatacatcctctgcaaacttcttcagttcctctttcggaagattcaatgtctccatcaattcatcaaacatcactttatgaatatacttgccgattacctcatgttggcaagcatcacgcacgatattcacacccgacaagtatgctaccggagaaagaaccgtgtgaggaccattgagcaaagttactttgcgttcgtgataaggagcttccgacggaacaaacaacacattcagccctgccttatcagccgggaattcttttgccacttcctgcggagcttcaattacccacaggtggaagatttcagcctgcacaacaaggttatcatcgtactgtatcttttccttgatagcagcaatatccttgcgagggaatcccggaacgatacggtctaccaatgtcgcatatactccgcaagcttcctcaaaccaagtcttgaattcattgccaagattccacaggtcgatatactgataaatcgtttctttcagcttgtggccattcaggaagatcagttcgcaagggaaaatgatcagacctttcgtcttgtcaccgttgaatgttttaaaacgatgatacagcaattgagtcagcttgcccggataagatgaagcgggagcatcttccagtttgcaagtcggatcaaaggcgattccggcttctgtagtgttcgagataacaaagcgcatttccggttgttcagccagcttcataaactcgtcattctgcgtataaggattcaatgcgcgactgattacatcaatcattgtcaagctgttaaccacttctcctttatccaatccttgaaggttaacatgatacaaatcatcttgtgcattcagcatatcgaccatacctttatcaatcggttgaaccactaccacactgctgttgaagtcagtcttctggttcatgttgtaaataatccaatctacaaatgcacgtaaaaagttaccttcgccaaattggataatgcgctccagacgttgtactttaggagctgtttctttgtttaatgctttcatgttagttgtaatttataaagttgatattatacaaattcgaaataaaaatcaatattttcctttatcataatgtcgataggcatgtactttaccggttcaacggatttcttgaaaacgacgtggtcgcaaagagcttttacgccacaatatccctgcagtcccggacgttgcccgatcagataatgcacatcaccggatttcagcaattccacgtttgctttcagaaggtcatatcctatcagccccttcatgcttcgtcccgcactacggagatattcgcccagctgataaactctggaattgaatacgacacccaacgtagctttcggatgcagccggaaaaattcatccaatgtcttttgattattttcctgattagacttgttcagcaccacttcatgaatcaccaacttttcatactcttcggtgataaagctcataaatcctgccaaacgccgttgcatctgtatttctgccggactgttcttattattgctcaagaacaaaaccagctcctgcccctcgccggcctgatagttgcgcattaatattttggcggcaatgtatccgcttttataagagtcctgtccgatataggtcagtgcattcgcttcctccatattgaagtcaatgaatgcataggctacttttttagcttgcagatagtctgtcaaagccaatgtctcatttctgaagttcggagcgatcagtacagcatcgacattactttcttcaaccctgcgacacacttccagataactttccttgtccccttgctggtaacaaagataatccacgctcacattgaaaggacgcaattcctgacgtgcccgctcaatgcctcccactaccgaatgccagtagtcatgctctatataataaggtatcagacaaacgaaagaatatttcttcttggcagccagtccgatagcaaatacattaggctggtagtgaatttcgtccaataccttttgtactttagccttgctttgaggagatacgtcgccgcgattgtgcagcactctgtcaaccgttccggcggaaacacccgccatacgggcaatgtctttgatggtatagttctgatcctccatagtgctaaaacttaaatattataaataatcgctgcaaatatacgaattattttgttactccaagtaaattttctatttttgtgttcgataacggttaataaaactaaaacgaagatttacacctattagctttaaaatcaatactatataggtataaatgcagaaagtaataattttatatactaaaaacacagtaacaatgaagaacttcatggatgaaaactttttgctgcagacagaaactgcacaaaagttgtatcacgagcatgcggctaaaatgccgattatcgactaccactgtcatttaatcccccaaatggtagctgacgactacaagtttaaatcactgactgaaatctggttgggtggcgaccactacaaatggcgtgcaatgcgtacaaatggcgtagacgaacgttattgtacaggaaaagataccacagactgggaaaagttcgaaaaatgggctgaaaccgttccttataccttccgcaacccgttgtatcattggacacacctggaattgaagactgctttcggcatcgacaagattttaagcccgaagactgcacgcgagatttacgacgagtgtaacgagaagctggctcagccggaatactcagctcgcggaatgatgcgtcgctaccacgtagaagtagtatgtactacggatgatccgattgattctctggaatatcatatccagacacgcgaaagcggttttgaaatcaaaatgttgcctacctggcgtccggacaaggcaatggcggtagaagttcctgccgacttccgcgcttatatagaaaaactgtctgcagtaagcggtgtgacaatctccaatttcgacgatatgattgcggctctccgcaaacgtcatgacttcttcgcagaacagggttgccgcctgtccgaccacggtatcgaagaattctatgcagaagattacaccgatgcagaaatcaaagctatatttaataaggtatacggcggagctgaattgactaaagaagaaatcctgaaattcaagtctgctatgctggtaatcttcggcgaaatggactgggaaaaaggatggactcagcagttccactatggtgctatccgtaacaacaatacgaagatgttcaaattgctaggtcccgatacaggcttcgactctatcggcgaatttacaacagccaaggcaatgtctaaattcctcgaccgcctgaacgttaacggcaagttgaccaagacaatcctttataacctgaatccttgcgccaatgaagtgattgccactatgctgggtaacttccaggatggttcgatagccggcaagattcagttcggttccggatggtggttcctcgaccagaaagatggtatggaaaaacaaatgaacgcgttgtcagtacttggacttttgagccgtttcgtaggtatgttgacagactcccgttcattcctttcctatccacgccatgaatacttccgccgtacattatgtaatttggtaggacgtgatgtggagaacggagaaattccggtatctgaaatggatcgcgtaaatcagatgatcgaagacatcagctacaacaacgccaagaacttcttcaaattctaaaacaagaaatactaaatagtaataccgctgtcggagcccgatgctccacagcggtattttttttaaaactaacgctcctctccctgcagtttcatatacgattctattgtcacttgtcaccttttatagttaaagagttagtaatcaataagattgtggtgacaataagcggtgataataaggtgataatagaatttatatgaattcatttatcaccttttattatcacctatatcccctactatattgattaccaacatttaaacagaaactaacatctttttctctttatcacagagaactgcattttcgacccgagaattgtattttcaccccctttttgccttctataattccaattaatcaattatttctcccttgagccaacaacaaaattttatttgctaaagcattaaacgatgcttctttgccctcctaagagattttagatggcatgtataatagttaaagccagtatacctaatacatcaacaagccttgattaatacattttgcaggatatatgctctcgtttcacgtacgtgaagcattcggactacgcacgtgatcccatcagtccacgtacatgaaccgatgggatcacgtacctgaaacttgttcttattgctttcagaagacattaacttagcatacaaaagggattaatcaacgaagcatagactattaaaccagggaggtctgattaaatcgacaagcatctttcggactgcctccttacaaggaagttcatataaacaaaaaaaagaagtaactaagttacttcttcatcctttgtacaccctcagggattcgaaccctggacccactgattaagagtcagttgctctaccaactgagctaagagtgcaacatttttttatattgcaactttggatttgtacaccctcagggattcgaaccctggacccactgattaagagtcagttgctctaccaactgagctaagagtgcttatttcctcgtttgcggttgcaaaagtaggtcttttatttcatttgaccaaacaataatgcagcttttttactatctttttttcgttattattcgaacacataaagctcagaaggcgtatttcgctttaaagcaagtagttgcacatctttacctacaattacacctttgttctttaatttccattctactgttttatatgccagctccggatgattattgtctttgctcagatgacacaaccagatataacgcaggtgctcggtgatattttctgccaggaattcagcagtagcagaattgctcatgtgtccggtcctgctcatgatccgttccttcagatattggggataaggtcccattttaagcatttcttcgtcatagttcgcttccagaatcagatagtttgccttgctgatataatctgctgccgtcggagtgatttcccctaagtcggttaagaaagaaaagactttgccgtctatttctatacagtatcctacattatccgtcccgtcatgaggaacttcaaaagattcgatacggaaatcttcgagcatcataggcacttgcttttcaagataacgaaccgatgtgctgagcttttccgtcatacaataactacgattaatcccctcatgaatacgagccgtggtgtaaacaggtatattcatcttttcccccaaatgccctacggccttgatgtgatccgcatgatcgtgcgttacaaatacggcacgtatactttccatcagaatattgaaatctttcagtgttttcttgatggtacggatgccgataccggcatctatcagtattccataggtatcagtacccagataatagcagttcccactgctgccactcgccaggcttataaatcttactttcatgttttatctttctttattaaaatgcaaaatgccgtcaacttttacagcaaagtgacggcaaatatacataaaaaagaagataattaccgagaagatttcttctttttgtcgatggattcggtgatttttgcgaataatagcaaagctatggcggcaatcagcccgatagcagcgaaataataccagatataatgcgcattcgcactggcggcctcccatgccgcacgagtttcaaacaaggcagggtccggacaatattttgtcaacagaataccagccagcccgaaaccgaatatagaagaaaggaatgagtgcagatgactgaatcctaaatacataccttcctctcccttaggagcctgcagagagaaatactccagataccgcggcgaaatgaaacattcggcaagcgcctgtacaacaataccggccaccatcatcagagtaatattgctcattcctgagataatatcatttcccaatatgtttccacatgccatcagcaatgcagaaaccggaatcaggaacatccccacattcatcgaagtaatcgcactgcgctttgccatcaaacgagtgataaagctgacacaacataccaccacaaaaggattaacgttcgcgatccatcccggtttagctgtttcgcctgcgagacggatgacgtacttaggcatagtggcataaagttgctgttgtaccatccagaagcctgttacgattaaaatgagaatcaataaacgccagttagtcataatccgcataaagccctgccctatctcacgcagactttttccttcacctgccgtatgagtcgatttatatagcaggatcactgccagcaaggcaatcaccgtcatcgccccggagaaatagttaatgtaaatataagcttgttcgccgatcacatttctcaaagggtcgataattgtcttacccgtaaaagcaccgacattgaccatcatataaaaaatagaataaccacgggcgcgggtcgcttccgttgtctccttagctacagatgcggaaataatagacttgataaaagaacctcctatcataaggataaacaggataggaacgataatccaccgggaagaactgtccggcaaaccattaaaccgggtagtcgcaccgtaactcaccaaccctgccgcttcgagcaatgtagggaatacgcccagccccaaataaccgatagataataaagaaaaggcaataatcatcgacttccggaaacctatcttatctgcataagcacccgaaaatataggaagcaaatataatcctccggagaaaagaccggaaatcatacttgcttcgaaatcattaaaacctaaaatactggataaataaatagtgagaacgataaaaacagcataatatgccatacgttcaaacagttcgactgtgttactcacccaaaaggctcttgtaaaacctttggcggcacgctgaggggaattgttcatgtaatctctgtttttttattaaaatgttaattcagcgcaaatatacgtttttttagcttacagtccgtatctttgtcctaaattacgtattctaaatatatcataatgactatagctgttgattttgacggaacgattgtagagcatcgttatccacgtattggtgaagaaattccatttgcagttgaaacgctgaaattgttacaacaagaaaagcaccgtttaatcttgtggagtgtacgcgagggagaacttctggacgaagccatagaatggtgcagagccagaggactggagttttatgcagccaataaagactatccggaagaagaaagagatcatcagggcttttcccgaaaactgaaagccgatctgtttatagacgaccggaatgtcggcggtattcccgactggggaattatctatgaaatgataaaagagaaaaagacatttgctgatatatacagccagcaaagagaagaaaataccagtcagaagaaaaaaagaaaatggttgccgttttaatctccgacgcgaaagatcataccttacatccattaataaaaatgcataatgcactccgggcacatcgcttcagagtgcattatgtattttctgaggagatctgaaacttacattactccttttgaccttcccacttttctctatattcccacagttgttcaatagtaggatgaaaagtcggattttcccaatttttggaaatcatcgaaattaaagactccagataaagtttaccatcaatgattgaagtacatgcattaacctgatacttttctgtcgggtaactcttcgtttcaagcatcttcttcgcccagcccaacagctcctggaccgattcttcatcataagtatgttgtgccatatttttatattttcctacaaagataaagataaaaacgagaatatgcagacccggacaagcacttttagtatttcaccttatataatatagatttcttgagagtgaaaagatgcctttcatgctttcctgacattaatcaaatgcaatgttgtcattcacttttattagtgttaatttctttattccatatttttattgtatgtttgtgaacatatagcttcttgcagcaatcaagaagttgtataaattaatcaatagcaaacaaatcagagcatcatacatagacaaaaacaaaggacaaatgaacccaagtgaaacagaacctactacccaaaatgtaatgtcatcttcagaaccagaaacattccctttaacaaaagatcaacttctgtttgcagaaagtatttatgcttgtctgccaatgagtattgagatctatgacacaaatggtatcttgcgcagtatcaatgaacatgcattgcagatgtatggagtcactgataaaacgactgtggttaatatcgtcaatctttttaatagtccttatatggacgaaactctcaaaaatcgcattcagagaggcgaagatattgttctggaattcgaatacgactttgaccggataaaagacaacgcatacttctctacccaaaataagaacacgatcatttatgaagcaaaggttgttcccctgcgaagcaaggagggagaaatcatcgggcatatattgctttccaacgatgtgactgccataaaagaagctgaatttcgtacggatgaaagcaaaaagaatctggaaatggcaatggaagcggcctctatgtcatcttgggtatatgacgtgtataagaaaacattcaatccattacatggagatcctgtagctaaaaataacacgacattagatcagattctaaatatactgcatccacaagatcatgaacctttaatacaacttttatcacaactgaccaacaaagaaattcagcaaggaaacatcaccttacgtttctataatgaagaagaaaagcaataccgctattatgaaagcatgatgcggttatctttcgaacattttgggaaattgcagattataggaacccaactggatataacggaaagaatgcaaatggtaaagaagacgcaggaattaatcgccaagcgtgaactggccatgaaagtcagcaatatcattcattgggatttcgatgtacggactcaagagttcgaagcctataatgacccgatcaatgattatgccagtgataaactggtgaccatccaacgatacatggatgttattcatcctgaagaccgttcttcatcctatgacgccatacagtctatgctatcaggcaaagaactcaccattaacttcacttgccgtatgcaaacgaagtatgatgaatcctggcaatattgtaatatcataggtgttccattcgagaaagacgaatatggtaacaacgtacgatataccggattcagacaaaatatctccaaacttcatcaactgaatgaagaacttgaagaaagaaactacaagatgcagctcactttcaaaaccgtaggtatgtcctactgggactttgatgcaaagagcaagcagttcagagcatttaatgacccggtcaatgacttccactctgaaaatgtaattactcttgaagaatatctgcatgccgttcatccggaagatatagatatggttcgtgagaatattaattatatgattaatagaacaactaaagaagtaaactttaaattccgttccaaaacaaaatgggataaagaatggcaaacccttattgttacgggtattccggtggaaagaaataagaaaggcaatgtaatccgctacaccggtataaaagtcaataatacgaaatgggagaaaatggcacagcaactaaaggagctgaaagacaaagccgaactttccgaccggctgaaatcagccttccttgccaatatgagtcacgaaatacgtactcctctgaacgcgattgtaggcttctccgaactaatggtctattctgaagacccggcagaaaaagaagaatacatgagcatcatccaatccaataatgaattattattgcggttgattaatgatattctcgacctctccaagatagaatcaggaatacttgaacgcaagagggaaaccttcaacctggccaaagtttgcggtgaattatatacgatgattcaaccaaagataaccaatccggatgttgagttccagatggccaactcaggtccggactgttggattttcctggacagaaaccgcctcaagcaagtatggatgaactatcttacaaacgcaatcaaatgtaccaaatccggacatataaaaatgggatacggcatcgaaagaggaggaatccggatttatgtggaggattccggagtcggtatcccgatagaattgcaggaacgagtgtttggacggtttcagaaactcaatgaatttgctcagggcaccggactcggactggctatctcaagagctatcattgaaggagccggaggagaagtcggatttacttccactcccgatgtaggatcaacattctgggcatggattccttgtgaaataagcattcaggaagaagatagcccaaccgtttcgcaaccatcgaagcaacaaacttcgctgaatgaaatagacaagaaagaattgaagatactgatagccgaagataatgacagtaactatacgttagtgcaacatattctcaacaattataacctcacccacgtacaaaacggagtggaagcggtaaataaagtacgcgaagaagaattcgaccttattctcatggatatgaaaatgcccgttatgggagggttggaagccacccgcaaaattcgggagttcaatcaaaagatacctattattgcacttacggccaacgcctttgactccgatagggtcagtgcccttgacgcaggatgcaatgaatttctggctaaaccgataaagaaaagccagttgcttgaacttttttcgaagaaatggtaaagtttatatataaatatataaccgcatggtttgtctaagtttaccgacagaaagagtgtttcattaattcataaattaaattgtccggtgctttttattgcccggattcaacttattatttatatctttacgcgctataaacttaattagataaactattaaaagtaatgatcatgagaaaaattatcattctggtatgttactgttttcttctggcagcttgcggaaacagtgcgaaaacaaacaatagtacaagtgcggacagcacagcaaccgaagtagtcgatatacataatgccgagacatcgcttgactatgaaggaacctacaaaggcgtcttccccgccgccgactgtccgggcatcgaaacaacgctgacactaaaccccgacaagacgtttactcttcactctgtatacatcgaccgggacagttcatttgatgaaaagggaacttatacactcgaaggtaacatattgactctaaaagaagaaggaggagaaatatcttattataaagtagaagaaaacaaagttcgtcttttgaacgatgacaaacaagaaataacgggagcacttgccgaacactatatattaagtaaagagtaagttaggaaatcctgtcattacagaaagataccggaaataaagtggcagatcagccattttatttccggtatctttttttgtttctatgttttatcattttccgaaaacaatttcaatattttttatgtttatatagatataaaacaaacttataaaaagaacgacttatgatttataattttttattccccaccaagccgaatacaacaaaagtatctttgttcctattggcagcccgcatcattttcggaatattattaatgaaccacggtatacagaaatggagtaattttcaggagctgtcaacggcttttcctgatccgatcggtctgggcagttccatatctctcggattagccatctttggtgagttggtatgttcgatgggctttatcgttggttttctataccggttggcaatgattccgatgatctttacgatggtagtggccttttttgtcattcacgctaatgacgtatttgcagtaaaagaattggcattcatctacttagtagtatttgtattaatgtacattgccggacccggcaaattttccatagattatttcattggaagcaagttggcgcacaacaaacgtaaatgacataaaaacaagaaataataaccttgattaatttaaaaatgttatatttgcatctattaaaaagagaatttatcaatattttattaatcaaaaagtaaagtaaacatgaaaaaaagcaaactgacattagtagcggttgtacttagtggtagcttattattcagttcctgtgttggatcatttggcttattcaaccgtttaagttcctggaatcaaggagtcggaaacaaatttgtaaatgagcttgtatttttagctttcaacattgttccggtttatggcgtagcataccttgctgatgccttagtaatcaactctatcgaattctggagcggttccaacccgatggctaatgtaggcgacgtgaagaaagtaaaaggagagaacggtaactatatggttaaaacgcttgaaaatggttattcaatcaccaaagaaggcgaaactgcttctatggatttgatttacaacaaagaagcgaatacctggaatgtagttgcaaacggtgaaagctctgagctgttaaagatgaacaacgacggcactgctgacctgttcttgccgaacggtgaaaaaatgaacgttacattggatgctcaaggcatgatggctgcccgtcaggctactatgagcaacttgatgtttgccgctcgttaaaagcatatacaataaaacaaaaaggagatgaaaccgtataatcagtttcatctccttttttattagcaatgattgatcagaaaggatatcctaccgcaaaatggaaagcaaaatcacgactgaacttaggatggataatcggataacgatctttccccttttcataaacaggattaagcgccttcatacctccgtcaaaacgaagaatgaagaaatccagatccagacgaagccctaatccgtacgctaccgctatttgcttatagaatttatcgaatttaaagactcctcccggctgattgtcataatcacgaatggtccatatattaccggcgtccacaaagatggctccctgaaacttccagaataatttgcttcgatattcaatactggcatccagcttgatatcaccggactgatccagtaaattggtattttcatctctcacaaaagaacccggccccaagtcacgtactgtccagccacgaacactgttggcaccaccggaaaagtattgtttctcaaacgggatagtcttcgcattcccgtaaggaacagcaattcccatacctatatgaaacgcaaatgagttacgatgatctatccttatattcttagaaaagtcaaattctcctttcacatattgtgcatatggaatgcccagaatagcatattccccatcattattcttacggatattcgttgctttggataaagcatacatgatatttcccgctgattcgaaattaaaacggatggaatatgaattggaagcaattgtattattaatgatggcaccaccaatactattgtaatgatagctatatcccatattaataatcaaacggtcctgataattatactgaagaatatggctctgccctttgttaataaaatcatccttaaacctctccgaaattctcggcaaataaaggaaaccgatattaatcaaatcgatacgatgttgtattttctggcgttgagtccacttatagctccatgaggccgatgccatggtacgtagaaattcgggacgcatctgataattatactgtaatccgaactctgtagtagccctaatcttccgtttatagtccgaagaaagaaaaggaaacaggaaattaggaaaattgatacttgtctccactccatattccatataattattattggaataacccgcctgaagtccggaaatcacttcataagcaccacgaaacttgatcataaaagtctccgaaccgcgaaagagattcctgttttgaaaagagacggaagctgctgctcccaaatcaccggctgaattggttccttccaattcaaaagctaccgacttgtgcttactcttggtcaacatcacgtagcagtcaagcttcgccgtatcccctacctgattttcaagaaaacggatattggtatatttcaaggcggacagacgtccgaaattggaataagtctgctgcacatcctgttcattgaacaaatcacctggagcaaagcgaagattatcagtaagcatcttcgggcgtaaatagagtttatctttataataaatggggtaccctttaaaatgaagagaatcattgatatccatactgttcagcgcagaagattgcaggacatcataatccgtaataaagttaatcttatttatccaatattgttggtgtgctttcaccgaatcgctcacgtgcgctctgtaggcgtgcaaatgcaaggtcaagtctacctgataagtaccccgaaccgtatctgccgtataaccgacataatccttattgaacttataataaccattccgaagcagcttgtcagtaattcgctgacgctcggcatccagcacgttcacatcaaatatcattccttctttcagcagacttttggcggaatcctgcttcagaaaatcagcaatcttaggatcgtggatatcatatttcaatgaattgacaatataaggatcgccggctgtcacctcataatacagcttgatctttttcttctttattttagtcgaacgcttcactgtggccgccatatagcccatattgcgcattgccttcgtaatttcatcctgcgagcgctgcgcttcagtctcactatagattacaggagcatccccgattcttctcaggaacttatttccccatttagtagagtctcgtcctgaaaggttgtaaacataaagctgtgttttgattaaactgaaccatttggcattagggttctgtcgcacatacattcgtaaggaagaaggacggacatttttctgatctgtatgaatcttgacttcatccagcagataagagccatccggcacatacttagtggcagtgcacgaagcgagcgacagaatgataacggcaaaagtaaataagtaaagaaatcctttcctcatacagtatctctataaaagcggaagcaaatatatagggacaaagatagagcatatttttcgttcggggaaattatcaaaacaataattaatgcgacaaaagttcttttcaccacgaattatagaaattcacacagatattctgactaatacctatcctgtcgactgtatatgctgatgatcttttctataaatcgtgatgaagaaaatttctaattcttttattggagcctgaacataacaggaattgtgtattttacacttacaatttctcccttattcatacccggtttccattggggcatcgaatttatgacacgaagagcttctttatccaaatccggatcaatgctacgtactactttcgcaccagaaatactaccatctttgttaaccacaaactgtacaataacgcgaccctgaattttattttctatcgccttcgtcggatacttgatattgcgactcaaaaaactcagtagttctttctgtcctccggggaaatccggcatcgtttccactactgaataaatagaatcacctttcgtctcagtgattgcaacctcaacctgaggctctgctgtcttatctggctcagcagctactatagtatctgctttttctgtatcagactggactttatccgctttcttattagcacaattactgaataacagcaataatgcggccactggtataaacatcagatacttacctaccatgatgttatgagttctttttctgtttagcattttaattcgtttttttaagggtaatacactaaagttgttatagaagtttgctgcagccaatgaagtatgtttaattcccaacaaatgatattgatacgatttcttgtcatagccggacgtcactacttgcttgtccgccagatactcatgattcatacgtatttcactgcgtatcaaccaggaaaacggattaaaccaacataataatataatcagttgagccagtattatatccaatgaatgaaattcacggacatgagtttgttcatgtatcaatatctcattaatttccttatccgaatattgcatcggatttatgaatatccagtgaaagaaggaacagggctcccctacgtcttccgactgataaacaggtacacctttcagagaatagcgccgagagcaggctaaagaatgatgtattttactaacttctaaaagattacgcagtaacaacatacctattcccaatccataaataatccataaccaagtaccggcctgccaggttgtcccttcaacttcagttgtagcaacgggtacagctgtagtaaccagcacttccggtaacagtttattgtaaacggtagtaatcgtttctcctattgcatactcgtccgtccagcctgaaaaatcaatcaatggataaatcagcgaagtcacacatatcagcagcaacatgatccgtctcagcctgaaaaatgtatccttgctgaaagagagcttatagaatgcatataatacaatcaaagctacatttactttaatcaaatagattgcaaaagattccatgcctatcttgatttatgattcttcatcctcaataatattgattaaatcctcgagttctttcttgctgattttacgatcgcggacaaaaaaggaaaccatttctttgtacgaacctgtaaaatagttacttactactccattcataaagctacgcttatagtcgctttctttcaccagcacatgatactgaatagaattccctaacttgaaaggagacaagaatttctttttctccagattacggactacagaggctacacttgtatatggcggttttggttccggcatttcattcacaatctcccggataaaactcggtcccattttccaaaagtaaatcatcacttcttcctcttgttgtgtcaatctttccatatcgttatattttatactgaatatcaaactactaattttaagcaaatctactaaatttaagtagataatcaatttttattcatacaaatattgttaatatgagaaagaattattttcaaaaaacttgttcaacagccgatttattaaaaatatatttatagctttgcggtaaataaagaagtaaaagaataatgctaagcaaaaataaaataaagtatatccattcactggaactaaagaaaacacgtaaagaagaacaagtattcctagccgaaggtcctaaattaacaggcgatttactaggacatttcccttgccgttttctagcagcaacttcttcgtggttacaagcgcatcccgacattcaagcaaatgaaattgcggaagtctctcaagaagaactatcacgtgccagcctgctgaaaacaccacagcaagtacttgctgttttcgagcaaccgcaatatatgttaagtccggagttcgcacgccagtctctttgcctggcactggatgatattcaggacccggggaacctgggtacgattatccggctggcggactggtttggtatcgaacatattatctgttctcagaacacggtagacgtatacaatcccaagaccatacaagccactatgggaggaattgcccgtgttaaggttcattatacctctcttcccgaatttattcattcactcggtgatgctcctgtattcggaacatttctggatggggaaaacatgtacgaacaaccattatccaccaacggactgatcgtaatgggaaatgaaggtaacggaataggaaaagaagtggaagcactcatcaatcggaaactttatatccccaattatccacaaggaaaagaaacctcggaatctctcaacgtagctatcgctaccgcagtaatctgtgccgagttccggcgacaggctgcatggaagtaaaatcaaaaggataaaataaataaggaaacagtacttctcccctcttttcagacgccgcaagagcctctttaaaacattgggaagtttgatccgaaactataggaaaattaaattgaaacactgggatgtttttttcaaacatctcagtgttttttatttcattatcggggagtaatgcgatcagtccgggcatccattcaacagactcaatttcttccgtcaacggaaaaatatcccgtgcatagccttcatcagcaatctctactacttgttgtctgataaagccaacatcaggcagaagcaaataatgagcggcaaagcgtttcataatattaacgggaaggtgactgacgtctttgctgatttctacgctgattcaattgccgttcccttctttgctcaatcttctcctgctggatatgttgctctacttcaatctgttccggcttcttttcaggagtcaccgtacgacggcgattcatttcttccggtgatatacgttgattatccttcagatcatcgactttttgcaaagagtctttcgaaatcttgttatctttttgatcggataccttctttaaagaatctgtcttcaaagcttccagctgattaatcgaatcacgttcggctacagaaagcgagtctgagcaatgataacgggttaaagaaaaacgatcagccagtaatgcaccggctttctctccctgtactcccgggtaatagataaaaccttttatttccttcatcacacccaatgtatctgcatacaaacgtaactggtgaacacccggatcagtgattgtttccaggcgatttaatgtatccttttcataaataacctgcatggccatcgtaacagctctcaaagaatcggcaagcatcggttcgaggaaatgataacgtacttcccaaactaatgtatcacgatctttataattagtatcggcaggtaatacaaaggcatactggtcattcatcatctcacccgtcagacgtatcagacgtttccagggccagacatcaatactatcacccggttccgacatcttcggtttattgtcacgcaaagctatcagatgattaatttcattctgctgggctttcaggcgtttgctcaccttttcataaattttcgataatacctccgtgttgcgtgtgtaccacaccaaagacgaatcgaatacagcttccgttgtaccgtattttttgaaaacggcatcgagatacagagtcttcttataattctcattataaggcagattatctcccatagactttgccagatgataatcatacagcaaattctccatcttcgattctgagattacatcgtcaggtcttttgactttacagcctgctatcgcaagcgccaacatgcaaacacaacacagatgaaaccgaaacctactcttcatgatctacgctttcctttttatttttatccagtgaatggtaagattcattcagatacttgctatagaaaagtagcaaagcaatgataccacaactgatggcagcatctgcaaagttaaagatcggactgaagaatataaaatgttctccacctacgaaaggcatccatgtaggccagtttgtgtcgataatcgggaaatagaacatatccactactttgccatagaaccaggtagaatatccaccgccttcgggcataaagctggcaatctgtgaatgagtactttcattgaaaaagacgccatagaatacactgtctataatattccccaaagctccggtcaggatgagggccacacagacgatatatccggtcttgaagcctttttttataatcttataaagatagtagcctatcagccctactgccacaatacggaaagtggtcagaaacaactttccaaatatttccataccgaaagccataccgttgttttcggtgaaatagatataaaaccagtccgtcacacgtatgctttcatgccaatacatgtgagtcttaatccagattttaatgatctggtcaataatcagtacggaaaagataacaagcagggcaattctacccttcgtgaatagtttcttcatttgttcatcataaattaaacataacgagctacaagttgccgtgcgtaaacattgcgcagctacttgtagctcgtcatccgtagcttgtagctatctattattttttaccactgttcttagcctcgatgctgagtgtagcatgaggaacagcacgcaagcgttctgccggaatcaactttccagtctcacggcaaatgccatacgttttattctcaatacgtaccaaagctgcctgcaatccttggataaacttcagctggcgctgtgccaggcgagtcgtttcttcctttgaaagcgtattagctccttcttccaacactttataagtaggagatgtatcgtcggtatcattaccatccaatcccatcaagctcatcttcaactgatcgtaatcacgttgagccaactccaacttctccataataatggcacggaattcctcgagttccgcatccgaatatctagtcttttctgccataactttactagtttaaaaggttaatcaatattagtattagtcttttatcacattgacaaacaatgagaaatcgtcaaaattaagttctgtgccgtctttcacttcatctgccaaatcaagggatgttcctaaaacctggttacaaatataagtattatattcgttcaccgcatcatctgtttgcgtatttttggagattgtgatctttattttgtccgtaatctcgaaaccgctggacttacgtatattttgaatacgattcaccaattcgcgggctataccctcacgacgcagttcttcggtaacagtaacttcaagagcaacagtcagtttaccttcattggcaaccagccatcccggaatgtcttcgctgaagatttcgacatccgcagcttcgatcacagcttccgctccatccagattcaatgtatactttccgttcttttcgagttcagctatcgcttcctgagacatttccgctacagcagcagccacagccttcatctgtttgccgaatttcgggcctaacttcttaaagtcacatttcaccttcttcaccaatacgccggcatcaccatccacaaacttgatatcttttacattcacctcgttcatgatcaatgctttcactgcttcgatgtgaactttctgttcttcatccactacaggaatcatgatacactgaagcggctggcgaactttgatgttcactttacgacgcaatgccaataccatagaagttacgtcctgtgccatttgcatacgggcttccagttccttgtctatcatttcttcctgatacttcgggaattcagccaaatgaatagaaaccacattatcacgtcctgtagcagtgatcaaatccgtatacagacgatcggaatagaacggagaaataggcgccatcaacttcgcaactgtttcaaggcaagtatacaatgtctgataagcagacagtttatcctgagtaaattcaccgccccagaaacgtttacggttcagacgaacataccagttagacagattgtcattgacaaagtcagagatcaaacgtcctgccttagtcggttcatattcattatagcaagtatctacttccttgattaaggtgttcaatactgacaaaatccaacggtcaatttccggacgttctgccatcggaacatctgcttctttatattcgaatccgtctacattggcatacagcgcaaagaacgaatatgtattatataaggtaccgaagaacttacggcgaacttcttctattccttcaacgtcgaatttcaaattatcccatggagatgagttagtaatcatgtaccaacgcaacggatcagaaccatacttctcaatcgtagtaaacggatcgacagcattgttaagacgcttggacatcttattaccgttcttgtcaagtaccagtccattagagatcacggctttatacgacacactatcaaataccatagtagcgatagcatgcagtgtaaagaaccatccgcgtgtctgatccacaccttccgcgataaagtcagccggatatacttcacggttatccagaatgtctttattctcgaatggataatgaatctgtgcataaggcatagcaccggaatcaaaccagacatcaatcaggtcagattcacgcttcatcggctggccgtcttccgataccagaatgacatcgtctacatacggacgatgaaggtctatcttatcataattttcttcggtatattcacccggtacaaaacctttatccttgtacggattggatttcataaatccggcagctaccgatttttcgatttcattataaagttcttctacagattcgatacatatttcgctcgttccatcttctgtacgccagataggcagtggagtaccccaataacgggaacggcttaagttccagtcattcagattttccagccatttgccaaaacgacccgttccggtagactccggtttccagttgatcgtcttgttcagctccatcatacgttccttgcaggctgtagagcggataaaccagctatccaacggataataaagcaccggcttgtctgtacgccagcaatgagggtagttgtgtacatgcttttcgattttgaaagcctgattgtttgctttcatcatcatacaaagagcgacgtccaaagattcggcagtctgtgctgctttctcatcatatttgccgtctaccataaactgcggatcataggcattctttacccatgccccctgatattctttgtatttgtctacatccacacattctttcacgaagttttcatccagttcatccagtatatagaacttaccggtaaggtctaccatcggacgggtttcacccttcttgttaatcatgaaaagtgatggtatacctgccgcacgagccacgttcgcatcatccgcaccaaacgtcggtgcaatatgaacgatacctgtaccgtcttctgtcgttacataatcacccgggataacacggaagcctttatcacttactttccagctaccgtcttccgatacttcaaccggtttcacccagggaatcagttgctcatattccataccaataaggtcagcacctttgtattcggcgattactttgaatggtacgagcttatctcctgccttataatcttccagtttcagatcagcagctttcggattgaaatgagtatttaataaagccttagccagaacaactgtaataggttctcctgtataagcattatatgtctgaactgcaacataatcaatctttggtcctacacaaagtgctgtgtttgaaggcaatgtccagggagttgttgtccaagcaaggaagtaaggagttccccactccgccatttccggtttcggattcttcatcttaaactgggcaacagctgtcgtatcctttacgtcacgataacagcccggctggttcagttcatgagaactcagtcctgttccggcagccggagaatatggctggattgtgtatcctttatacagcaaacctttcttatgcagttgcttcagcagccaccacaatgtttcaatataacgattgtcatacgtgatataaggatgcttcatatccacccaatatcccatctgatgagtcaggtcttcccattccttggtatatttcatcacgtccttacggcaagcagcgttataatctgctacagagattttcttaccaatatcctcttttgtgatacctaatgctttttctacacttagttccacaggcagtccgtgggtatcccatccggctttacgctttacctggtaacctttcattgttttgtaacgacagaaaatgtccttaatggtacgagccattacatggtgaatgcccggcataccattagccgagggaggtccttcgaaaaacacaaacgaagggcagccatcacgttctgtcatactcttggcgaaaacctggttttcgtcccacttcttcaacacatctttgttcacctgtgaaaggtcaaactgcgaatattcagtaaatctcttacccatagctatatctacgattttactatttacaatttacaatttgaggggtatccccatttttaagggtgcaaatttacaaaaacatttgtttagttgagcaaaaagcaaggacttttaattggaatcatgtgaagttatcgtttataaatggatgttgcattaaacaaaaccgatatctccttgttttagtgggaaaataaaaagcacttaagttatgaattacggtattagtattttattcagagcaatccctttggcgatggcggtcttttgcttcggatacggagcattcatttacggttatggtgatgcgggaaaccgtctggtggcaggtcctgttgtattttcactaggtatgatatgcattgcgctgttctgtacggcagccacaataatccggcaaatcatacatacctataatgaagcgacaaaatacgttttacctgttgtgggctatctggcagctatcataacaattatcggaggtatctgcattttcaatgccgctaccactacttcagccttcgtcgcagggcatgtcataaccggtgtaggatttatcacagcttgtgtagctaccgccgctacctcttccacccgattttctttgattccggccaatgccaaagctaccggaaatgaagtgccggagggagcgttctctattggccaaagacgggcaatgatctttctcgcaatcgtcatttcctgtatcgcatggatatgggcgttcatcctgttaagtaacagtcattcccatcctgcttattttgtagcagggcatgtgatggtagggctcgcatgtatttgtaccagtctgattgcattggtagcaaccatagcccgtcaggtccggaacgactattcggaaagagaacgtaacaaatggccgaaactggttttactcatgggatcgatctcttttgtatggggcatattcgtcatccttgccgactcgggaagtgcaaacggcactaccggatacatcatgcttggccttggtctggtatgttacagtatttccagcaaggtgattctgctcgctaagatatggagacgggagttcaagctggccaaccgaatccctatgattccggtactgacagcattaacatgcctgtttctggctgcctttgtattcgagcttgctaccgtaaacgctgattattttattccggcacgagttttagtaggactgggagctatttgcttcacactgttttctatcgtcagcatattggaaagcggcacatcttctaaataatagaaaagtcatgtcccaaaggtatatgtttactctcttttaggcacagattacacggatttcacagtttttgctataaatgaatgtctttagaaccgtgttaatccgtgtaatccgtgcctaaatactttttacaatcaataggcgcttttactcttatttcttgaatctgacttcgtaaacatcatttctacgatccttcagattgcgcacactaccgtaagtatggagtgcattcaataaatccagatcgacatccgaaaccagaatcatttccgtattcggagtggcttccgcccgttttccatcagttggaaaagcaaaatcacatggagtgaatactcccgactgtgcatattgaatatccatattatgaacgcggggaagatttccgacacaacctgctatgactacaaagcattcattttcaatcgcacgtgcctgggcacagacacgaacacgggagtaagcattctgtgtatcagtcaggaaaggtacaaataagatttgcattccctgatctgccatcaaacgggaaagttcaggaaattccacatcataacagatcagcactccgaccttcgcacaatctgtatcgaaagtttgcagcagtttaccaccgctcaatccccaactcttgatttcatccggagtaacgtgcattttttcatacatctcataagttccgtcacgcctgcaaaggaagcctacattatataacagaccatcttcctttacatacggcatacttcctgtgataatattgatattgtaactgatagccaggtttataaaacggtctctaatctcatcggtatactttgccaatccacgaatagcctgcgattctcctttatcattaaacttcgacatcaaaggagcgttgaaatattccggaaaaagaacaaaatcacttttataatctgatacggcatctacaaagaactccacttgttcgaagaggtcgtccaatgtcttgtaactacgcatctgccactgtaccagtcccacacggacagtcgtctttgggttgatatattcctgcgtaggcggctgataataaatattatcccactgcaacaaacaggcataatgcttggattcctcatcattcggcaaataattggtcattaccttgcgaacatggaaatcattcgataattggaaggtaagaaccggatcataaatttcacgctggcgtacccgtgcgatatattctttcgggcgcatcttatcggcatatttatgataattcggaatacgaccaccgaacatgatagctttcaaattcaatgtttcgcaaagttccttgcgatattcatacatacgacgagccaggcgcaaaccgcggtatcccggatgaataaacacctcaataccgtacaggatgtttccttccggattatgagtattgaatgtttccttacccgtaacttgtgcatacgtatggtcgttctttaccttatcatagtcaactataatagaaagagcacaacctacaatcttgtcgtcaacgactgtcacaatctgcccctccggaaaaatacttattaatttctttatctgggcatgagtccagaatacatcgctaccgtcagagtaaacacgggtaaacgattgggataactgtgcatagtcttcaatttgaagattacgtatctgtactttattgattttaataggatgttgttccataacaatacatgttttataaaaagacagtgcaaaggtacagcttatactttaatactgtttttaaaccaatgaatatttatcattcttacttcaaagtctcctattcgatgtcttgatttcctgtacgcacagtccggagtattctatttattactcatacttgattttattgtaaaccaactgcatgtattatttgcaactctcactaacatcagcatgaccggaacttctaccaatacccctaccactgtagccaatgcagcaccggattgcaaaccaaaaagcgatatggccacagccaccgacaattcaaagaaattgcttgcaccaatcattccggcaggtgcagctatactgtgaggcaatttccaccatttcgcccaactataggccacaaagaatatcagaactgtttgcaacacaagcggaacagcaatcaatacgatgtgcaatggattgttcaatatggtttctccttgaaatgaaaataaaatgataagcgttaatagtaatccgccaatcgtataattatcaaacttacggataaatacagtattaaaatattctatcccttttcgccggatgaccagtatacgggttattattccggcagaaagaggaatgacaacaaacaatacaactgaaagcaataatgtatcccacggaatcgtaacgccacctatacccaataaaaaagcaacaataggagcgaaagcaaccaatatgattaaatcattcactgcaacctgtaccaatgtataggcagcatcccctttggtcagataactccatacaaataccattgccgtacaaggtgcagtacccaataagactgcccctgctaaatattcttcggccaattcggcagatattagagacttgaaaacaacgtagaaaaatagataagctattccaaacattgtaaaaggctttataagccaatttgtaatacaagtgatgataattcctttcggacgcttaccaacgtttttaatactctgaaaatctactttcagcatcatggggtaaatcattaaccaaatcaggatagccacaggtatagacacattggcgtattctaatttactcaatgtttgcgatattgccggaaaccattgtccgatagcaataccaacaacaatgcacaaagttacccaaacagtcaggtatctttcaaaaaatccaattcctatatatttttccatccgatcaaggcagcattaccttttgacaattgttctactttctcaatccaattcacttcattttgcgctttcgcctgcaagaatgtattttccgtatttgtcattgacaggcaggcatttacggcccaccatttgttattaattccggcacgctgcaaatccatttgcaggcgttcagcttcaaacacaggtgtcgcttcaggtaaagtaacaattacaacttccgtttcctttggattacgcaagcgaggcaataaattggctaccgctcccgtaactgctccttgtgtacgttctacttctctatggtagctttgggtagcatccaaaagcaacaatgtatgacctgtcggtgctgtatcaatcactacaatttcattgtccgccttatctacaatttcggcaaatgccttgaaaactgctatttcttgtgtgcatggcgaacgtaaatcttcttcaatatattccatatcttcggcagtcatggtttctgccgctttgctacgaacttcattcttgtagttttccaatacttccgcttcatcaatatgactgactgtgatacccgattttatagcgatgtcatagttcagatgatttgccgggtcagtggtagtaagatgtacctttgcaccaagttttattaatttcagagctatttcagttgctaaggtggttttacctacaccgccttttcccattgtgaacactaccctcttaccggaagtatagaggtcattaaccaaatcgtctatacttttggcatcacttatcggctgataacaaatatcatccgttagactgtcgctgtataacatacggcgtatattagctatatcagataaattataagaacgtagaggaacgctgtacataggatattcagatagttcagcaggcataccctgtaatgctttttgctgcctgttatgcagttgtcgtgacacatcatccgcttcattcagttgctgtaaaataccatttatcaccaataactgatttttaattcccaatagctgtaattcatgtgaagagcgggcagcttctttcagtggagcaatttctggacgactgaccaatactaaccgagttgcgcttgtatcagatagggtttctaccgcctgtttataaattcctttccgttcttccaagcctgataactgccctaaacaggatgcaccatgggcactttcactaataaatgtactccacgcagatggaagctgcaacattcgcaatgtatgtccgataggtgctgtatcaaaaataatatggtcatactcctttgctttaacagcatcggtaataaaatctgagaactcattaaaagcagcgatttccaccgtgcaggaacctgaaagctgttcttccatattctgaataacactttcaggtaattttcccctgaaaggtgcgataacgctttctctgtattctgctgctgcctgctcagggtcaaggtttacaacagtcagtcccggcacttctgaaatagctgtaccgtgtccgtttaaggattgatcgaaaacatcttgtaagttagaagccggatctgtactgataagaagtattttctttcccatatcagccaaaccaactgctgtggcacaagcaatggaagtctttcctactccacctttacctgtaaaaaacaggtatttagtcagtgctatatcggataaattgaatgctttcatttttttttaatataaatctgttatacatttatttagcgggcattaaatctaaatttactcccgtccattcactcatttgtttagtggtaggataaactttagaaactgcaatttcaccatctaccaaagtaataggtaaagcttctgcaccattcttttgaagatattcatttactgttttattactcacatacacctgtggttcatcccgtaagttgtgacggataacaataacaccctgtcttttcaatgtttcgacaacaactgcaatcctcattaattcaggattgatatttgttccacacaaacctgtagggcaacacattgccgggtcaaaaatttctatctttttcatactgtcttttattttaatttatcaaattgttcagaaataaaaaacgaccgcataatagattcctatgactataaagagtatagcaacaattttgcgaaaccatttttcaaaaatttgtacgctgttataaaaccgacctaatccggctacactatacgccaatatccaagcaacaaggattacaggcacccctgtagcgatagcatatattacgggtaaaaaatacccgcccgtttctgctgccgccaaaggcataagtataccgaaatagaaaactccactggtggggcaaaaggctagagcaaacaaaatacccaataacaaagctccccaactaccttttatattcttctttagcccctctccgccaatattgattttgggtatatttagctttataatatcgagcatgaatatccctatgataattaataccggagcaatcagcatctcaccgtatttgcttaccaccttttgaaccatatacatacttgccccctcacgaagaaccggaataagaataaacccaagtactgtataagtcactatcctgccaaatgtataaagtaacccatttatgaatatacggtgacggttttctatatccttacctataaaacctattgccgttatattagtagccaaagggcacggactgattgccgttaaaattcctaagataaaggctgttataacagggacagaactattgtctaatagtgattgaagaaaatccatcctacaactgttttagcaattcatcaactttatttttaattccctctttaaatttgtccggtgattttcttgcattggaaaaactgaactctgtcatgttgtttacattttcttttccatctttccaaccattcacaaacagggacgaccaagtaacttcgtacttgtccgcaatttgcccgttttccttttttgaaatatctataaccttatagataatcctatcgtctgcctgctctttggaataaaggctatccaaaagggctactatattagtttctattgcccgacaggtgatacaacgctgcgctccgtggaaataaagcacctcaatatggtcaggcagcttttcttccgtattctgtgcctctgtttttgcttttgcaccattaccacaggatattaagataatggttgagaatagtaaataaaagaatttcttcataactatagtattattgggttatcaattcttttacttctgcaagtgataatcttttcccagcagatacgatttttccgtcaatgactaaagccggaagacttaaaacattatattccatgatttttaataaatcttcctctttgattaatacgacatcgcaacccaattcaaaaattgcttgtttagttgtttcatacaatgccttacagcctgcacacccggttcccaatactttgatttccattttctattctatattaaagtttatctcttaatcgtaattcgtagaactacgaacaacattcttaaaaaaaagtgctgttatccacagcacgatgttcctgtacatttacaatctcccaaaaatgcagcaaataatttgcgggcaacttcccaattttccttgttaatacaatatcgcaccttgggcgtttctatttctccctgaattaatcctgcatctttcagctctttcaagtgctgtgaaacggttgctttagcaataggcaattcttcgtgaatatctccaaagaaacaactttcctgtttagccaaaaaactaagaatagccattcgtgccgggtgtcccatagctttagcaaaacgagctatctgctcctgctctactgtatactgcttttctttcacttcaatatctcctctatatttgttgttcgcaaaactacgaacaatattttaatccgcaaaattaattaggtattttttcaaggagtaagcataaaatgtatatatcagcaaatcactttttacaataaccacctgtataataacgtattacaatgacacatcttttttctcagccgaaagattaaacacataataccgatttccgaaagacgtatgctttgccatatatcccatggctgaaagtttcagacccaattgacgtgcagagacttctttcaaagctgtagagttgaatttacgcatcacttgaaatatttcagctgttgtcagccagatacctttttccgtttccaaaggatgacggaaacaacaatgaaacacatcttctagtaaggactggcgataatatgccttgttatgtttctgcaaagccttttcttcttctttgtttaaataatccggtgcgccggatttcagctcttctttcagttgcgcatatatttgcttatgctccaaaggttcttccgaaataggttttaacacctccacacacagaaaacgacgacttcctgtggagtcaatcaatacctgatagacatttgttgtggctataaaagaagcaagacgggactcattcacccatcccagtcgcttgccacgaaaaacgggaacattcaccatttgaagaagattctttaatgtagcctgttgactctctttaatcttatcaaattcgtctaaattaatcaatccgtttttcacgagcttcttctccggcgaactgcctgctgtcagattcagattatcaataaaataatgccgtaatgagtcgggcatcagcaatcggcaaaaagtacttttactcaatccctgcttcccgcttatcaatacaggagtaagtacattggcgtgcagacgttcttccccactccactgtgaaagcattgcccgtaaccagcaacgtcctcctcttagccatatctcattatccgaaacacgtagcaataaaggggtcacacgatctactccatcccaacccggcaattcctttacataaagatggaaaggattataagaccccactttatttgaaagaatcatggtaggcacatcccctctccagcaaggtattccttccaggcgggcatccacaatcattccattcatttcgcgttcatcaataggtcggaaacagttctttccactcttctccctatattccgtagctcctgtcaaattgttataacggaaatcaaaattgtcattcaaatactcttttaattgcaaagtcaacgattgactccatttattagatttacccgttttttcacctgtcttctcagactcttccttcttcttcagtgtcttttgttccacgatttcggatacctcgtaattggcaactaccggctcctgcatttgctgtttctgcgcaaacaattgttttattgtctctaccatttctctaattattgttttcatacttgctgttttttttaaattattgtgaggtttgagacacaaaaatagactaccgaataccggatttgcaaataagctgactcattcttttttgaaaaatgatctaacagaaataagcctttgaagtgttgtttttgattagaattattagtaattttgacgcatcatattaggcgtagcaccagtcgtgcgatagctgtcgcacataatgagcgacagttattacacaatatgtgagttagctgttgcacataatgtgagccaatcaatagaaaggcacgaaataaataaaatgactgcgtaagtctgctaattgatacgcacaaaacaactaaagcaatgaatgcactttatgatttcttcctgactccccaacctaaagattccaataaaacgagatatcatgcccgactggttgtacgggacaccatcacactggaagatatagccgaaacgattgagtccagaagtagtttaagacaaagcgacgtaatagggtcttttatagagtttgccaatgttttcaaacaagaattatccaacgggaatagtattcacattccgggagtcggttcattccgtatcaaagcggaatcacccgaagtacgttctcccaaagaaatccgtgccgaaaatattcattgcagtggaatcgtttttactccggaaaaagatttgcttcgcgaattaaaggctacaacttttgaaaaggtcagtgagacccgcaggtcacaggaattgagcgatatagaaatagatgggagattagctgaatttttcaaagataactcttgtattaccacacagcagctttgttcattatgtggacttcgaaaagccactgcactccgcagattacaaaagcgggtggatgaaggaaagctgactcatccgggctatatccgttctcctttttattttcctgtgccgggatggttcggagtatccagaaatagataatgcaaaataaaccactgattcacagattataatatccatatatgattatgacaccatacaatttgcatgatgtcataatctgaataatctcacgtcacaatgacatgataaaaaaacactaacctaatttatttgtttttcttccaaagcttactcatatcttccagcgtcttccctttagtctcgggtacccaacgccaaacaaagatagcggcagcgacacagatgattccgtataagctatatgcaaacatcggactgaagtcatacaatgccgggaaagtagaagatacgatgtagttgaatatccattggaaagccactgcaatagcaactgctttaccacgaatcgtattcgggaagatttctgaaatcaagacccagcaaatcggtccccatgacatcatgaagaaagcagcgtatacgatgatggaaagtaccggaaggacacctttgattgccatgctatcacacattgccactgcaaatgctcctacagccataccaatagatccgataatcagcaatggtttacgaccaaagcggtctaccgtaaagatagcaaccaacgtaaagataatgtttacaatacccataatcactgtctgcatcataccaccaccttcggcacctgcattttcgaaaatacgcggagcatagtaaagtactgcattaataccgatcgcctgctggaatacggacagtagaataccgatcacaatcactgttactccataagtaaagagtttctctgttttttcctgagcagtagccttaatatcattaagaatttcctgagctttcttcttaccgttgattttctccagaatagtgtaagccttttcttcctgctgtacaagaaccagataacggggagtcttaggaacaaagaacaaaagcataccgaagaaagcggccgggaaagcttccgaaccaaacatataacgccatccttcctgaactgtccacatatccgactcagcacttactgacagtacaccggcagcatctttcagaataatcggattctgatggtcacccataatcagatagttcacaaagtacacaaccaacataccaaagataatggcaaactgattgcacgaaacaagggttccacgaatattggaaggagcaatttcagcaatatacatcggacataccgccgaagccagtcctactccgatacctcccagaacacgatacagattgaatgctatcaacaaatccatattcggttttccgtattcgaagaaaagaacttccggataataagagccgagtgccgagaggaaaaataacacagcagcaagccgcaatgagttacgacgtcccaaacgggaagcaaagacaccggataaagcaccacccagcacgcagcctatcaatgcgctggaagaagtaatgccatgcattaccttattatactgaaaatcggaagcggacaggaagaaggcttcgagccctttttccgcgccggatataaccgccgtatcataaccgaagagcaaaccgcccaaaatagcaacagaagtaatcgaatacaagtagagtttacttccttcgttcgttgtattattcatagttttaaaaagtggataaagtagtgtagtagttggattagaaaaagccaggcgataaagcagcagccctaccgctgctttaccgcctgttttaaatattgattagcaatacatattcagaattgcttcataaagttcttgcttgccgctagtctgtttcggttcgccttttgtttttgcataagcaaccacatcctccagagtcagcttgccgtcttcaaattctttacctttgccgccatcgaatgaagcataacggtcagccagcatcttcttatagggagactcgtcgagcagagctgctgcgctttcgagtgcacgggccatagcgtccatacctgcgatgtgagcaataaagatatcttccaaatcagtagaattacgacgggttttagcatcaaagttcgtaccaccggtaccgagaccaccattacggataatctgcatcatagcctgagtcagttcataattgtcgatcgggaattggtctgtatcccagccattctgatagtcaccacgattggcgtcaattgagcccaacataccattgtctacagctacagccaattcatgctcgaaagtgtgacctgccaaagttgcgtgattcacctcgatatttactttgaaatccttatccagaccatgagctttcaggaagccgattacagtttccgtatctacgtcatactgatgtttagtcggttccatcggtttcggttcgatcaggaaagtacctttgaaaccacgggcacgggcatagtcacgagcaatcgtcaacatctgtgcaaggtgttctttttcacgtttctgatctgtgttcagaagagacatatagccttcacgaccaccccagaatacataattctctccgccaagctcaatcgttgcatcaatcgcattcttaatctgaacagcagcacgagctactacatcgaagtcaggattggtagctgcaccgttcatataacgggcgtgaccgaatacattagcagtaccccacagtagtttgataccggtttctgcctgtttctgttttgcataagctacgatttctttcagattagcttcgtattcttctacactggcacctcccgaaaccaagtctacgtcatggaagcaatagtattcgatacccatcttctgcatgaattcaaatcctgcatccatcttatcttttgctgcctgtatagcatctgcattaccattccatgggaattgctttgttccgccaccgaactggtcaccaccttcagcgcacaatgtgtgccaccatgccatagcgaatcttagccaatccttcatctttttaccattaatcaccttctctgcatcgtaataacggaatgccatcgggttcttactatctttaccctcaaatttaatcttttcaattcccggaaaaaattcttttgttgccataattcttgttatttaaaaagttattatatcgttatttatattatatttccatctagcgtatgcgtcggcgtattcctgacgtttagctatattcggttcgataacatccagcttatcaagagttgcaaatgcctcattgttatctttataaatgcctgcaccgatacccgcacccttcgctgctcctacagaaccgtccgtatcataaagttcgatagtggctccggtcactcctgccaatgtatcacggaagatggagctaaggaacatatttgcatgtccggcatgaatctttttgaccggaattcccatttgttccatgatgtcgataccgtatttaaaagaaaatacaattccttcctgtgcagcacgaataatatgatgtttgccatgtgcattgaagtctaccccccgaatgctgcaacctatctccttattattcagcatacgttccgcaccattaccaaaaggcaggatgctgatacctgcgctcccgatcggcgccttggaagccaacacattcatttcattgtacgagataccttcgggagctatatttctttttacccatgaattgagaatccctgttccgttgatgcaaagtaacactcccagacgcgtctgttccatcgtatgattcacgtgcgcaaaggtgttgacacgggattgagggtcataattcacttcaccattcaccccatagacaactcccgatgttcctgccgtagaagcgatttcacccggattgaacacattcaaagaaagcgcattgttcggctggtcaccggcacggtaagtaatcggtgttccttctttcaatcccagttcattcgcagcaactgcattcacacgcccttgttctgcaaaagtcggtttgatatccgcaataagtgaagagtcgaagccatagtaatccatcaggaaatcggctacacgattatttttgaagtcccagaacattccttccgaaagaccggaaacagtcgtgcagatatctccgcttaacttcatggcaatataatcccccggaagcatgatcttatatatctgctcatagacagccggttcattttgtttgatccaagccagtttagacgctgtaaagttaccgggcgaattcagcaaatgagaaaggcatctctcctctccgattgtttcaaatgcttgctgcccaaaaggcaccgcacgagaatcacaccagataatggcaggacgcaatacttgctgattcttatctacacataccagtccgtgcatttgataggaaataccgatagctttaatctcagcagcactcactcctgactccgccataatagcttgagtggacaacttcaggttttcccaccaactctcaggatcttgttctgcccatccgggattaactgcgataatcttcgcttctgttttcgggaaaaacgctgacgatacacatttacctgtttcagcattgaccagactcgctttaacggacgagctacctatatcataacctaatagaaacatgatgatttttaaaattttgaattatatatttaagcaaacagcctgttcacttattacctattacttattacctatgacttattacctactaccgtctcaccttattatatatcttcttatcaaatttataataacgcgctgcacgatgggctactccctgctgtttttcttccaaaggaactacatattccatcatcgctattttcttatggaagttgcgcacatccacaggcttgtcatataccaactcaaaaagagtcctcaactgggcagcggtaaatttacgtggaagcaactcaaacagcatagaaggattgaactccacaaactgacggatataggtcattgcctctttaataatcagattatggtcgaaagccaatgtcattacatctttcaaagcaatccaacaggcctgatgatcatccagattcttgtccagtgcccggtctattttcaccatcgacagataagcaattgtcacgatacgttcaacttttgactgcatagcccgttccagccagcgtacatcctttggattgctggttctgtttttagagccgaatgccttgaattgcatcaggtttacatttctgagccccgtcaattcatacagtacacgttgtgctgcttcatccaaatcttcatccatatagataaggctaccgggaagtttcatatcgtgatacacttcaccattatcttcgcccgcacgttttacaagtaacactttgagttgttctccgtcaaaaccaatcactacacagtctactgatatgtgattgtttgccaagggtgcttttttctgtatactttgcatatccttttctttaatacgatgcaaatataggggcgctttatgattcgaacaataacaaatgacatgctataaaacattgtttttcatagatatacatatcatacaatctacaatatgagtacttagtgttatcttctgaattacaatatgtattttacccgttccggcaacgagtaattgtataaagtacaaaaagcggaatgactctttattatcagcacttttcatattcaccctttgtcttctccggcaacggacttattgtatttcaaacgatatcccattttgtatcttgccgtttttattctatctttgccggataaatattaaaaaatctaaaatggaacgtcatcccgtcattttatccattgccggttccgattgttcgggaggagcgggcattcaggcagatatcaaaacaatctcggcattaggaggctatgcggcatctgctatcaccgccgtcactgtgcaaaacactctaggggtacgcgccgtccatgcaataccacccgaaattgtttgcggacaaatcgaagcggtgatggaggacttgcagcctgtcgctataaaaataggcatggttaacgatattcagatcgttcatgtcattgccgactgtatacggaaatattcaccggagcacatcatttatgacccggtgatggtatctaccagcggccggaagctgatgacaaatgaagccatcgaagagattaagaaagaacttttgccgcttgtcacattagtcacccccaatatcgatgaagcaaaggtgctgacaggcaagagcatccaaaatacacaggatatgctggaagctgccaaacaactctccgacagttatcagatccatatcctgatcaaaggcggacatctggaaggcgatcaaatgtgcgacctcttatattctccggatcacacctattatatatatgaagagaaaaagatagaaagtaaaaacctgcatgggaccgggtgtaccctctcctccgctattgcaagctatctggcaaaaggatattcgatgaaagaatccatccgtcacgctaaagaatacattactcatgccatcattgcaggcaaggacttgaatataggccatggcaacggacctctgtggcattttcccgactccattgcacaaatgtgtacattttgtgcggtcgtatcataaaaatctgtaactttgcacccgcatttaaaaatcaattaaataataaagatatgaaagcatttgtatttcccggtcaaggtgctcagttcgtaggaatgggtaaagacctgtatgaaaactcagctttagcaaaagaattgtttgaaaaagcaaatgatatcctcggatatcgcattacagatatcatgttcaatggtacagacgaagaccttcgtcagacaaaggttactcaacctgccgtattccttcactctgttatctctgctctttgtatgggcgatgatttcaaaccggaaatgacagccggacactcactcggtgagttctctgcattggtggctgccggtgccctgagctttgaagacggattgaaactggtttatgctcgtgcaatggctatgcaaaaagcttgcgaagcaactccttctacgatggccgctatcattgcattgccggatgaaaaggtagaagaaatctgtgcatctgttaatgcagaaggtgaagtttgcgtacctgccaactataactgcccgggacaaatcgtaatctccggttctgtaccaggcatcgaaaaagcctgcgaactgatgaaagctgccggtgcaaaacgtgctctcccattaaaagtaggtggtgctttccactctccgttgatggacccggctaaagttgagctggaagctgctatcaacgcaacagaaatccatactcccaaatgtccggtatatcagaatgtggatgcacttcctcatactgatcccgcagaaatcaaaaagaatctggttgcccagctgactgcttccgtacgttggactcagtctgttaagaatatggttgccgatggtgctactgattttacagaatgcggaccgggtgcagtattgcagggattgatcaagaaaatagatggtacagtaagcgctcacggcattgcataagcattcgtagatatactttaccttttctcaactatagagcgtgtcgactagtttgccgatacgctttttttatgcttattagtcaaacatgagacaattaatatgctgtaaaacacaccattagtcttctctacgagcaaacattccgaatctttcacttgttttcattataggaatcatttattcaaattcgcggaccatgaaaatacatgaatatcaagcaaaagaaattttctccaagtatgggatccctgttgaaaggcataccctatgtcgaacggctgccggcgcagttgccgcatacaagagaatgggctcggacagagtggttattaaagcacaagtgctgaccggcggacggggaaaagccggaggtgttaaactggtagataatacagaagatacctatcaggaagctaaaaacattctgggtatgagtattaaagggcttcctgtcaatcagatactggtcagcgaggcggttgatattgccgcagaatactatgtcagcttcaccattgacagaaacacacgctcggtcatccttatgatgagtgcgtccggtggtatggatatcgaagaagtagcccggcaatcaccggaaaaaatcattcgctatgctattgacccattcatcggtctgcctgattatctggcacgccgtttcgcattctcgctcttccctcacatagaacaagccggcagaatggccgctattctgcaagcactctacaaaattttcatggagaatgacgcatcgctggttgaagtaaatccattggctcttaccgccaaaggcatattgatggctattgacgccaaaattgtttttgacgataatgctctttaccgccatccggatgtactgagtttgtttgatcctacagaagaagaaaaagtagaagcggatgctaaaaacaaaggattcagctacgttcacatggatggaaatataggctgtatggtaaatggcgccggacttgctatggcaacaatggatatgataaaacttcatgggggaaatcctgccaacttccttgatattggcggtagttcgaaccctgtcaaggtggttgaagctatgaaacttctcttacaggacgagaaagtaaaggtcgtcctgataaacattttcggaggaatcacccgttgtgacgatgtagccatcggtcttattcaggcattcgatcagattaagagtgatatacctgtcattgtccggctcacaggaaccaatgagcatctcggacgtgatcttttacgcaaccatagccgttttcagatagctacaactatgcaggaagccgctttaatggctatcaaatcttaagatgaaatcacataaaaaatgaaggaacaatgagtatattaatagataaatccacccgtttgattgtacaaggtattaccggtagagacgggctttttcatgccaagaagatgaaagaatatggaacgaatgtcgttggcggcacttctccgggcaagggaggtacggaagtagacggtattccggtattcaatacgatgcatgaagctgtaaaacagacacaggctaatacttccatcatctttgtgccggcccgttttgcagcagataccattatggaagctgcggatgcaggcatccggctaatagtctgtatcgcagaaggtattccgaccctggatgtcatcaaagcacatcggtttgccgaacaaagaggggcaatgttggttggccccaactgtccgggacttatttctcccggagaaagtatggtaggaatccttccgggacaagtctttcagaaaggaaatgtcggtgtcatcagccgtagtggaacactcacttatgaaatagtatatcacttaacgactaatggtatgggacagtctactgcaatcggcatcggaggagatcctgtggtaggtctgcatttccttaaactactggaaatgttccagaatgatcctgaaacgaaagcaattgtgttaatcggagaaatcggaggaaacgcggaagaacaggctgctgaatatattcgcagtcatgtaaataagcctgtagtagcatttattgccggacagtctgctcctccgggaaaacagatgggccacgcaggagccattatctcgggaggttccggctcggcaaaagacaaaatagaggctttagaagctgccggcatacgagttgcacaagagccttcggatattcctaagttactgaaaagataaacagaaccacacggagaaatagagctttgggcttttgtttctccgtgtggttctattttatgtaccaatatatccccgcgatgataaagtaatatctgaaatttacattccctttttcacgcctaactttattaataaagcattcatcggataagcacagaaaaagccaaaaagcatagccagctgcatcataaaccaaaatatccatgtgtctttaggcaaaggctcattgacaaataaaacaaaataaacgattgccatccagccatacattccgatttgccaagacaacagagaaaagaaatctgctttaaaagcacgggacagtacctttcccaccgatatcctctccatctcccgaatagcatagaattgaaaataaactccgatgattaacgccaatataaaatcaagtacccagtttcctataagctgacttcctgcaacggttaccgggatataattagtgaaccactctcctattatatcagccaatgtgcagcctgctccacaatgtaaagccgataaagccacagactgccaatgaggatgtttcatggacatatctcccatcgacatatccatattcatgtctttcataccggacatatccattttcatttcaccacctcccatcttcatgggagcaccttgtccgaacttattataagcccataaagctaagtaacttccccacaatgcagtcaatatccatactgcattcattatcttcattgattgtggacgatgtgtcagatcgattgctatgtgaactgcaattccgatacctgaacagactaaaaacacggctaataaattgagcataattgtatatttaaaaagattttagactacaacagcccttatttataaatagttcatcccgtccatttttaaattcatcccatcgaactattctccttactgtttgtttataattttattaattaaatattgaattgtatgagcagacgtagtcaattagagcatgaagtatctgttgctcaggaaagaattaagaaggcagccaaagatacaccgaaagatatcataaagttatgggaacaagacttggtagacttggaacttgaactcaataacctggtagatgatgaagaagataataatgaagattaactaaaagagggtgcacttcattgtgaagtgcaccctcttttagttgtagtatttttataagcagaatgcttttattgcttatccacagtggaaatacttatgtaccagttccagcatttcttccggtttgccttccatgtcggcacgtaatgttttgtcctcataactacggagcttgcgtataataccgtcaatcatagccggactaaatacattatattgctcgaagacagcacgttgtttttgcaaacattcggcagatgccgcacaactatccggcaattgagccaatgctttcagcttgtcctcattctctttctgatggatatttacatttacatacgttctctttgcaatgtccaatgcctgttctatctcaaaaccatgacggcaggcaacagccagtcccgcaagcagctgatacaaatctgccgaaccatccggagaacgcatttctaccgtttgtttctggctggtatcaaaatgactttcgctttccaatggatttgccaaagtacacatatcggtcttggcagcccagcccaacggtacacgcaccaatacagaacggttgcgatctccccagcaaacattggtcggtgcttcctgatgaggaaccaaacggaagtaagaagtaggattggtatttccgaaggctgtaatagaaggagcaagttccatcattccggcgattgccttacgggctgtttccgacaatacaccgtctttcagcatctgattttgtccgtcctttacaatacgcatgtgaacatgtagacctgacccggcttttccagccgtaatcttaggcgcgaatgtcacattatacccatatctgtatcccaagttacgaatcacccatttggcaatcatcaattgatctgccgcatcttcggcatgaacaggcaggaactctatttcgttctgttcataaatcatgccatccaatgtaaaattcccaacctcggaatgaccatattttatctgcccacccgtctgagctatatatgacatacactgcgtacggaaatcgttaaacttagcatacggagcagattcatgataaccgcgttgatctgtagcctgaaacattcctgtatccggtgaaataacatagtattccagctcacccatcgcctgaaactccatacctgtgacatcagtaaatgctttacacgctttatgcaaagtatgttccggagaactttccaatggctcaccgtctttattgaagaaagaacaaagcatcgaaagtgtcggtatttctgcaaacggatcgacaaaagcggtacggaaacgaggcactacatacaggtcgctactccccgcctctataaaaggaaacaggctggaaccgtccacccgctctccacaagtaaggatcgcatccagataagccgcattattaattacaaaattcaatgttttcagtcgcccgtcagcagcaggatacatgaaattgaccatacggatattattcttctgaataaaagaaataatatctgccttagtaaactcggcggcaggcttttccaaagcagccaccagacagttaggattcattaaaagttcttgattcatcttctatcggtttgttgttagtgaaccaaaggtaagaaaaaaataaccgcagacaataaaaagagagataaattctttggactttaagaaatagtccggccaggattctgcagaaacgaaagaaggtgtgttgggatcaccaacacaccttctttttatatactgattgttattcagtcaattagttcttcggcaaagcctctttaactaccatcggacggcctacatattcagcaccattcaattctttgatagcgttagctgcttctgtatcatccggcatttcaataaaagcaaagccttttgatcttcttgtttcacgatctgtgattaatttaactgaagcaactgctccatactcttccattacgtttctcaagtctgattccttaacgttatagttaagatttccaatgtacaaattcataaaatacaaatataaaaaattaataatttcaataacaaagttctttggaagttcttaatcagagatggatatgctcaataaatgagaagattcatgtgaaataatcaaatcgaaataaaccttttattgtttagtgagtgcaaataacggcatttcgcgggaataatgcactatgttctctcctttttcttttgcaaaatacccttttttatgaaataagaccaaaacttaacgtatgggtgttccagtgagagtctgtaataaagtcagaagccatattgaatgctttgcgcaaactctatcccggtgataccgggcacctgaatatcaaggatatgatcagaaatacccctatgacttttaatgctgaatataatgttcgtttcactgacatggcgataaagttactactttttcagaacttatacttcattcccatcgaaacatatacagccggtttgaaataagggtccgtatctctggacatatcttcgaaaaaggccttcagtgtacgtgttgtgtaataagcaatccggctgcacgataatcctcccatctctgctatcagacttagcttcagatatttattcagattcattcctgccgatagttccatcatagaaactttgatctgatagcgtccctcagtgctccatcgctccgtataccaaacgtatattttcggactttattctttgctccttacttttttattttaactttgtacgtagataaaatacctaattatggaaataaaaaaattcatcgaaaactatcgggaagcttttggcgaatatgctgaattgcctatcgtattctggtactcggacattcttgaaaatgaaaccgggaaagtgaacggatgcttctttaaaagcatgagtaaagtcaggggaggtaataccatcagtctgaatgcggaaacaattggttgcggcggtggtaagttttataccggattcaccgatatgcccgagcacgtgccgacgttcgtatctctaaaggaacgatataagcagacgccggaaatggtaaaaagctttattgagcaactaggagtaccaagggcagaaaaggaatatctgcattttgcccgtatagataaagtggaaacgttcgatcatttggaaggaatcctttttttggccaatcccgatatattatccggactgaccacctgggctttcttcgataataataaggaggatacagtgatttccactttcgggtcgggatgcagttctgtggtcacacagacgattctggagaatcgtaaaggcggatacagaacattcatcggcttctttgatccatctgtacgcccttattttgaggctgatatactgagttataccattccgatgtcgagatttaaggtgatgtatgagactatgcgcagcagttgcctgtttgacacacacgcatggggaaagattcgggaaagaaaccataatagctacaaagaataagaatatggattttatacttcgtccatggaaagtatctgatgccaaagccttagcaaggcatctgaataataagaagatatgggataactgtcgtgacgggctgccttttccatatacagaaacagatgctgatgccttcattaaatacgcttcggaacaagtggaacagaatgaatattgcatcgaggcgaatcatgaggcaatcggtaatatcggattcgtccgcgggacggatgtcgaacgcttcaatgcagaagtcggttactggatttcggaaacatactggaacaagggccttgcaacagctgctttagaaagagctatagaacattattttcagcatacagatgtaatacgcctatatgctacggtatatgaacacaatgccgcatccatgcgtgtgctagagaaagcaggatttcagaaagcaggaatacatcgtaaggcttgcttcaaaaatggccagttcattgatgcacattattatgaattacttaaaaataagtcgtaagcctccttgctttgttaccgtatatattactgccgactatctttatacagaacctaatacatcgaacgagaggtcccaattcatcacgaaccggaacctctctatgagttattactttcgaagttttactttatctctttaacttcttctcctttttcattcagaagtacggttacttcctgggcgtcttttgtagtgataattactttataaaccttaccggtttctttttcggcaacatacgcttccttgatggtagcatcttcatagcttttcgttattgcctgtgtcactgcttccggcaaatctttcacttcaatctttgtatactcatcctgtggagcttgtgtctgagtttccactgccggagtgttacttacttcctgtgcgaatgctacagaactacctaatcccaataccaatgctactgctactaatacctttttcataatcgtaattttttaagtgtgaataatagaactattgtttcttgtacttaatatatagcaaagcagatgccaaacgtttcactccgccatatataactgataatcaaacatataaacagcagacaatataaatataattgtggaattagtgtggaattatgtagaatctgttgatacataattggggaattactattcaacgctcttaatttggcaagaactgatttctttattcaactgttatatacctataacaacctaattatacaacaatgaaaaaagaagtcttaaaagagcttacagccaaaccggggaaggaacatcatgtatccgatttcaatccctcatttactgctgatatgtccaaacaggatgccaaagaacagttagcccaaaatatcgaaaagctgtcagaactgcaaagtatgctttatgcacaagaccgctactcggttctggttatttttcaggcaatggatgctgccggaaaagacggaacgatcaagcatgtaatgtccggcatcaatccgcaagggtgtcaggtgtactcctttaagcaaccttctgccgaagaactggatcatgactacttatggagaattaatcgttcgctccccgaacggggacgaatcggaatcttcaaccgttcccaatatgaagatgtactgatagccaaagtgcatcccgaaatcctgttatccaacaagctacccggaatactaaaagcgaaagatatagacaacgaattttggaaacgccgctaccggcagattaatgatttcgaacgttatctgactgaaaacgggacggtcatcatcaaattcttcctgaacgtttcaaaagccgaacaaaagaaacgattcatggagaggctgaacgatgaatcaaagaactggaaattctcttctgccgacgtcaaggaacggcaatactgggacgactacatgaaagcctactcggatgtactgacagaaacttcaacagagattgccccgtggtatgtgattccggcagacaacaaatggttcatgcgatatgccgtcgggcaaattatctgtgaacgcatggaaaaactggacttacattatccacagttatccaaggaggcgctggaaagacttgaagaatgcaagaaaaacgtatccgatattaatttctaaacaggatactttctcagagtttaacgggttatttctgtcaggacttgacaaagcccttttaatgttgtatatttgtaagcagaacaataataaacctataaaaccgtaaccaatgaaaagaagtctgtctttcaacatacctgctgtaatgtatcacatgaacggtaacatacagtcaagattgatcagtccgtaaggaaagtacaatattacaacaagacatatctatttccctataacaaataagatatgagtcatcagtatacaagctgaaggctgcgacttccaatggaaatcgcagccttttttgttgccaaatttcagcacagaaagccataaacgggattacatcgtttataataaactcagataccgttttactaaaactatcacaaagtttattataaacacaaacaccgatgattcataaatcatacatttttttcattgtcaccggaaggagaaatccactgttccggttcacgcacttcaatgaataaacaaaaagcgataaaataatacgtttcattgaaaatttgtactacttttgtaaacatcaaagcccaatcatgatttgaccggccaagaaattatgagaccgattaaactttttcaaacgagaatagtctaatctttaagatatcatcaatctaaacattaaagtcatcaatgaaaatggaaacatccgccaaactctattcgctgaattacagcaatgtgaaaacttacctgttcgccctgttattcgtagcaggcaacatcgcacttccacaactgtgccacctcgttccttacggtggaccgactttattaccaatttacttttttaccttaattgccgcttataaatacggctttcgggtaggattgctgacagctgttctttctcctgtcatcaatcatgtcttgtttgccatgccatccgaagccgttctcccgattatactgataaaatcaaccttgcttgccggtgcttccgcccttgctgcgcgtaccgtgaaaaccgtttctttgttagccgtccttggagtaattctctcctatcaactcataggaaccgcttttgaatggatgatcgagggagatttctatatcgcagtacaagacttccgtatcggcattccgggtatgctcattcaatggtttggcggatacgccctgctaaaggcaattgcaaaactctaaactaaaaaagaaagatggacagaagggatttttttaagacagtagctattactggtgccgccatgactatacagcgttcagaggcgatggaaatactgactcagacaatcaataaagcaaatggtgacaaaccggacctggtggccgtcatgggcggtgaaccggaagccatgttccgtcgtgctatcagcgagctgggcggtatgaagcaattcatcaaacccggacagaaagtagtggtaaagcccaatatcggatgggataaagtacccgaactggcaggaaacacgaatccgaaactgatcacggaaatcatcaaacaatgttttgccgccggagccaaagaggtcaccgtattcgaccatacctgcgacgattggcagaagtgctacaaaaacagcggtatcgaagcggccgcgaaagaagccggagccaaagttatgccggcccacctggaatcttactacaaacccgttgatctgccaaagggacaaaagatgaagaaggcgaaaatacatgaagccatcctgaattgtgatgtatggattaacgtccctatcctgaagaatcacggaggcgccaacctgactatctccatgaaaaaccatatgggtatcgtctgggaccgcggctttttccaccagaatgacttgcagcaatgcattgcggacatctgcacactggaaaagaaagcagtgcttaacgtcgtagacgcctaccgtatcatgaagaccaacggaccgcgaggtcgttccgcttcggacgtggtgctggcaaaaggtctctttatttcaccggatattgtagccgtagatacagccgcagccaaattcttcaatcagatacgcgaaatgccgctggacaccgtaggtcaccttgccaaaggagaagcactgaaagtaggaacgatggacatcgacaaactgaatgtcaagcgaattaagatgtaaaccaccatgttaagaaagatacgtatcggaatatcagtcgtcctttttgcactgattactttttattttctcgattttgctaatattctgccgaacagttttcatcgattggcacatatacagtttgtccctgccgtgctatctctcagcataggcatactgattgtactgattgcgttaaccctgttgttcggacgtatctattgctctaccatctgtccgatgggaatatggcaggatgttatagcacgcatttcaaagtctgtgggaaagaagaaaaaaagatatcggtacagtcctgcaaagaatatgctgagatggaccgtgctcggagtgactgtaattgcctccgtatgcggcttctcagtggtattgggattgctggacccgtatagcgcatacggacgcattgtagtacatatcttcaaaccggtgtatatgctgggaaacaacctgctggaatccgtattttccagattcgacaactacacgttttatcaggtagacacctcggtattaagcctttcttcccttcttatagcgatactgacctttgccgccattcttatattagcatggaaacatggacgcacgtggtgtaataccatttgtccggtaggtacggtattaggatttttgagccgttactctttgttcaaagtccgtatcgataccgcaaaatgtaatggttgcggactttgcgctaccaaatgcaaagctgcctgcatccacagcaaagaacacgctattgactatagccgctgtgtagactgtttcgactgtctcggtgcctgcaaacagaaagcgctggtttacgcccctgcttcaaagggacaacaacgttcttccgctacagaaaaacaaccggtggcaacagaatcatcttccgttgctgcagattcttccaaacgtcgttttctgcttgccggactggctactgccggagcagctcccacgcttcttacaaaggcgcaagaatccattgcgacgatggaaggcaaaaaggcatacaaaaaagaaaatccgattactcctccgggatctgtcagccagaagcgtttccagcaacattgtacatcatgccatctttgtgtcagcaaatgcccgtcgcatgtactgaaacccgctttcatggaatacggtctgggaggtgtgatgcagccaacggtcagtttcgaaaaaggattctgtaatttcgactgtaccgtatgcagcgatgtctgtcccaacggtgccatccctccgttgacggtagaacagaaacatctcactcagatgggctatgtcgtctttatagaagaaaattgcattgtcctcactgacggaaccagttgcggagcctgttcagagcattgtcctacgcaagccattgctatggtaccctacaaagacggactgactcttccccacgtcaatacagagatctgcgtcggatgtggcggctgcgaatacgtctgccctgcccgcccgttccgtgccgtatatatcgaaggaaaccctgtgcagaaagaagcgaaacctttcaaagaatcagaagaacataaagttgagatagacgatttcggattctagcagcatcagccccaaatatggatagctttcagaggattgtatacaattcaaaaaaactatccattatattcctcctactttcaataaattcactaaattcgtggcgaactaaaaaaagaaagtaactcatggaggtattcacaaataactggaatagccgtaaatatcagataggctatgctttaagcggaggatttattaaaggatttgcgcatttgggggtgatgcaggctctgctggagcatgatatcaaaccggacattatctccggagtaagtgccggtgcgcttgccggagttttttatgccgacggaaatgaacctcaccaagtgattgaatacttctccggccataagtttcaagacctgacaaagttagtcatccccaagaaaggactatttgatctctgcgaatttattgactttctccataccaatctgaaggccaagaatctggaagagttgcaaatccccttaatcatcacggctaccgatctggaccacggacgtatggttcatttccaccgtggctccatagccgaacgtgtggctgcttcctgctgtatgcctgtcatgtttgctccggtcaatatcgacggaaccaattacgtagatggcggattaatgatgaaccttccggtctccacccttcgcagaatatgcgacaaggtggtagccgtcaacgtaagtcccatcatggcgcaagactataaaatgaatatcgtaagcattgccatgcgctccttccactttatgttccgtgccaatactttccccgaaagagaaaaatgtgacttgctgatcgagccatacaacctctatggatacagcaacaccgaactggaaaaagcagaagaaatcttcgagcaaggttataagatagccaatgacttacttgaccagacactggcggaaaaagggaaaatatggaagtaactccttacttttcccgaaaatatttataatatgaaataaaatctactctatatgaacaacgaaaataaaatgattatctatcaggtgtttacacgcctgttcggaaacaataacaaccattgtgtctataatggagacattaccgccaacggatgtggtaaaatggccgacttcaccctcaaggcacttggagaaatcaggaaactgggtgctacccatatctggtatacaggcattatcgagcatgcaacggagacggattaccgtcgcttcaacatacgtcccgaccaccccgccatcgtgaaaggcaaagcgggctctccctacgccatcaaggattattatgatgtagatccggacttggcaaccgatgtgccggaacgaatgaaggagttcgagaatctggtacatcgcactcaccgttccggactgaaagttattatagattttgtccccaaccatgtagcacgccagtatcactcggatgcacaaccggacggcactaccgaactgggagcaaacgatgacccgaactacgctttcagcccgtacaataatttctactatataccgcagtccgagttgcgtgcccagttcgatatgaaagaaggcgcagcagagccttaccatgaatatccggccaaagcgacaggtaacaaccgttttgacgctacaccgaacatcaacgactggtacgaaaccatcaagctgaactatggagtggattatctgaatggcggcacttgccatttctccccgactccggatacctggataaagatgctggacattcttttattctgggcctcaaaaggtatcgacggtttccgctgcgatatggcggaaatggttcctgtagaattttgggaatgggctattccacaagtaaaggaagcacatccggaaatccttttcattgccgaggtctataatcccaacgaataccgcaattatctcttccgtgggaaatttgactatctatatgataaggtcggtttatacgatacactccgcaatgtagcttgcggctacgaatccgctgcatccatcacccactgctggcaaagtctgaacggaatagaaaagcaaatgctgaacttcctggaaaaccatgacgaacagcgcatcgcttccgatttctttgcaggagatccacgtaaaggaatccctgctctgatcgtttctgcttgtatgaacaccaatcctatgatgatttattttggtcaggagtttggagaactgggaatggacagcgaaggtttcagcggaagagacggacggactacgatattcgattactggagcgtggatactattcgtcgctggcgcaatggcggtaagtttgacggcaaaatgctgaccgaagagcataaacgcctgtacagcatttaccaaagagtacttacgctatgtaatgaagagacatccatcgccaaaggagtattcttcgacctgatgtacgccaataaaaacggatggcgtttcgacgaacataagcaatatacttttatgcgaaagtataagaatgaattgctgttcatcatcgtcaatttcgatagccaactggttgatgtagcaatcaacgtaccttctcacgcgtttgatttcttacagataccacaaatggaaaaatatcaggctacagacttattgaccggtgccaaagaggaaatctgtttattgccttataaagccactgaggtttccgttggagcctataatgggaagattctgaagattacattctgatctgctccgattgaaggcaaatgataaatcaatagtatcttaactctcctccttcccgaagggaggggaattgatgatactattgactttttaggcagccccaatggagatactactgatttattctccccaactgaaaacaaaaattctcaaaggctgtttagttagataaataatttcctaaaccagaaccttatgaagaaaattagttttttggcagtcatattattattgtctgtatctgccttcgcaatcttacctcccggcaatatacaggctgccttcaaaaagatgtaccccaaagccaacggtatagcatggtcgcaggatgatggctattattgcgctaactttgttatgaatggattcactaaaaacgtctggttcaatacgcaggctcaatggcaaatgacacagacggaccttgtcagtctcgaccgggtgacacctaccgtatacaatgcctttgtatccggtccttatgccagttgggtagtaaatgatgtaaccatggtggagtttcctaaatggcaggcaatcatcgtcattaaggtaggacaagataatgtagatatcaaataccagctcttttattccccgcaaggaatgttgctaaaaacccgcaatgtcagttatatgtacgacattctcggtccgggaacattcttataaaaaaagcccttgccaaacattaaatgctcggcaagggctttcttattttttattccctgagttatttcttctttctcaaaacaacagctgtacgtgcaggaatatagagtttcagccactctttcttttccttcttatacaacggatcggcaatcgtgaaatgaactactgaatcatctgcaagaccatttccgccaaatgcaacattatccgtattcaagattacttcataagctcccggactaacgaggaaaccataatctacaaaagactgtttcggattgaagttaaatacaaatatcagatccttacgtccataagccaatacctgatcaccatcattatgccagatctcctggaccggagtcgcctggaaatctttcacactcttgatcactttcagcatctcagcatcaaagtcccccatgtagtgataagccagattcttgttatctaccagatcccactgacgacgggcatacttacaagaccatccattaccttcacgcggaaaatcgatccattcgggatgcccgaactcattacccataaagttcagataaccgccattgatcgtcgaagatgtcagcaagcggatcatcttatgtaaagcgattccgcgattgactacataattctcatcgcctttctgcatatgccaatacatatctgcatcaatcagacggaaaataatagtcttgtctcctaccaatgcctgatcatgactttccgcataagagatcgtcttttcatcctgtcgacggttggttacttcccagaacatactggaaggcttccagtcctcgtcaatcttttccttgatagtcttgatccagtaatcagggatgttcatagccatacggtaatcaaatccgtaaccgccatcttctactttggccgcaagtcccggcataccggaaacttcttcagcaatagagatagccttcggattgacctgatgaatcaactcattcgccaatgtcaggtagcaaatggcattgccgtcctgatgaccattgaagtaatctccataattacagaatgcttctcccaacccgtggctataatacaacatagacgtcacaccgtcaaaacggaatccgtcaaacttatattcttccagccagtatttacagttggacaataagaaatggatcacttcatttttgccataatcaaagcatagtgaatcccatgccggatgctcacgccgaggagccggatagaaatactggttcggatcaccggcaaagttgcccaaaccttccacttcgtttttcaccgcatgagaatggacaatatccataataacggcaatccccatctcatgagcagcatcaatcagcgctttcagttcgtcaggcgtaccaaagcgggaggaagcagcaaagaaactggatacatgatagccaaaactaccataataaggatgctcctgaatggccataatctgaatacagttatagccttcctgtgctatgcgtggaagtgttttttcgcggaattcattgtatgtgcctactttttcctcctgttgtgccattccaatatgacattcatagatcaacaaaggattcgtagtaggcttaaatgtctttttcttgaatttatatggcttttccggtgcccagacttgtgcgctgaatatcttggtctgctcgtcctgcaccacacgtgtagcccatgcaggaatgcgttcaccttgtccgccatcccaatacacattcaacttatataagtctccgtgctgaatggcatctgcaggaagattgatctcccaattaccgtttttcagttttttcagcttataagcagctttctcttcccagttgttgaatgtacctaccatataaatatgagtagcattcggtgcccattcgcggaacgtccatcctttgggagtacggtgcagaccaaaataaagatagcctgatgcaaagtccgaaagagtttgttttcctttattggtcagctcggcttccttgttcagtgcatactggtgacgaccggtaatggcatctgcgaaaggttccagccagggatcgtttttgataatgttgagtgtctccttcatatcagaattgaattaggtttatgcttttacttttacgatcactttcttcactccgtcaggagtaatgccgggagcatgtccgtcttgcggaaagaagatggcaaacattcccggtttcacggctacgtatgtctctgccagtccttcaaagaaagtaatatctttttcgacattataaggagtgtcggcaggcacacaatctttggcagcagtataccccatcacttctgttcccgacaatgggatctgaatatcaataaattcattatgcgtttccaatttcgcctcttccttagtcttaggctttgtctgtgcgatattcactagcagatcttttcctttcagttcagtcttgcctatttccatggcttggaggtcatgagatttcaagaactcaatagcttgtgcaaacaaaggattcaaagacgcgtatttttccagattttctaaagtatctactaccatatgagtttaatttttaagtttatatttttaggtattattttattcaaaatcatcaattgtgtaattgatgaaatcggcaaatctcttgaactgtcggaatgctttctctatctgctccatcgtgtctgcccgagtgaaaaaatcatcgggaacaagataagaacagacaaactgtctgcacttcagataatcaatatatttaaaatctttcgggaatcccttgggagctgttttcatgaagtcctctcccactacaggaaaatattttttgaattcggggtcttctacaatggagatatactcttccacattgtcataaatggcttggcggacagctttcagtacattgggaggcaaacacaagcttcctccggcaagcatacttccgtcaggctgcagatgcacatagtatccgcaatgatcggacttcttgcctttggcattgatataaccgccaaaatgtatcttatagggtgtcttatccgcagagaagcgggtatcccgataaatacgataggtacaatctttgggctggattccccggattgtttcatcgaacaaagaaatgcgggcgattactgttgccagaaagttatcaaactcggcacgggctacttcatattctgaccgatgctcattgaaccactcacgattattattcgcagaaagatcttttaaaaactgaaagataacgggtatgttcatcttcatcattttctattattaccctacaaacgtacaaattttatttcatataaactacaaaacgcaacaaaaggacataaaaaaagcatcggcctggtaaaaccgatgctctaacacatttatcaaaaaaacagactcttctgcttctgatgtactctaagctttcacaagtgaagtacaatctcttttaattaatctttatctaatactatgaaaaacacataaatataacagattaaaaagaggctttgttcaacggttctgtatatatttccgttaattttagttatagaataaaatatttttcattgacaggtatgatgagccgtttccagtctatcatcgcattgaacaacatgatatgggagtaatcgcccaattgcgcctgccggatatctttctccactatgaaccgattatccaacagttccgcacgcttcgtcccctgaagcaagggatgagccggagtataccatgtatgtccgtcatacagcgctatgttggcaatggaggtatcagtcagatatccgtctttcactatcagaatatcgtctgccttccctctccgggcaaacagatcattcaattcttcccgattggtactcttgtaactataatcaatagtgtccgaagcaaccggacgcaaggaagaaaccattctcatttgataaggagtgtatccgacctcttcgatttccttaccgtacacaatccggcacttccagataccggacagagacggaggagatataaagccggacaaatcaatgggagccgcttctttccaaaaagcggcacgagtccggttcatgcgcgctgtgtgatacgacagattataaacctgtccgtcttctatgcgaatcgtttcaataaattggcacatatactttttgtttcatttcatgatattcactttccacttcactacggcaggttattccacctccgctcttaaaatacattctgtcgccttcctgctccacaaaacgtatcataacggcactatcaaggctacttccgtcgaaataccccatcacacccgtatagaatcctctctcatacgtctcggcttcactgataatctgcatcgtctttttcttgggagcaccggtgatagaaccggcaggcaagagtttgaaaagaatgtgtcccagattttcccgataattatccggcaaggttccctgtatttcagaactcgtctgaagaatagttccgcgattcgtctgcaacttatcaatatacctgtatcgggacacagatacccgatcggccactatgcttaaatcattgcggatcaaatctacgatagtagcatgttcggcagcctctttcggatcatccatcagttgccggacagccgaaggcaatgatgcatcaagagtacctttcatcggataagaactgatttttccctgttggattctgacaaatatctcgggagagaaaactgtgaactgatccctgacccacaatttatacattgcttttgaacggaagaaaatatctttcagactaaggttcgtctctatcggcgtgcggcatgtcagattggtcagaaagctgtttccggcaaatatattccgttgaacgatatcaaatgaccgacggtaactatcgaaagattcgggataagaattccagtggacaggttcttcaaaacaagaaagcacatccttcgatgaagattggttggtaaacccattcaggttatatactacttcagaagggtcaacagaggcaacttcttctatataagatgcatcctgcaaataattaataataaaaataaaaggccggcaggattgccctaaatggtttattttccgaatcgtttcttctcttgtatataattgcataaagtctttctttttgggaaagcaaaagtacgcaaaaagtagatcattcaaaaaaaaaagcaataaaaaagggttgccaaaatgttccccggcaaccctttctatctggaattggtagtttacttcatagctgcttgcacttgagaaagcatagttttagactttgtatcttccggagaaactttggtagcttcttccaagtaacctatagcttctttaaatctgccatctgccttttccttttctgcagcatatttgtctgcatcagagtttgccagaggagcagcctttttcaggatattcgcaccgtcgttatagcataaaacgcccaggctatacaaagcattggttttatatgttttatgatccaaaggaatcactttcttaaagcattcttctgcttcttcagcttttccggctttctgcgcagcaatacctgctttcaggtagtggagaccatagttcttaatcattgttttattgtccgggtctactttcagaccttcttccaaggtagcaacatactcgtcagtcttcttcatagcatccagtgccagcgctttacgggcataagcattacctatattgaatttcttttgaatagcaatatcaaagaaagtcacagcttctgcatactttttcacttcatctgcagccataccacagtaataagcgattgcagaatcctggttattcgtttgtttcagatactcactgaatttagcataagctacgggatagttcttggcattaaaagcgtcgcttccttcttttttcaattggctagggtcagtttgagcgaaaatgttagtcacagtaaggcaaaatgcaaataaaaaaatcaatttcttcataactttattgtgttttttagttgttaatcgtccaaaagtataagtaataacagagaatcgcaacatcattttaccttttttgagctttttgaaacctatataacgttcgttattcttcgtaaaaatagatttgcgagtgtccggcagggaggaaaaaagacactccttccgcctcaatgattcagcgaaaggagtgatattcaaatagtttagttattggtcagatagcgtttttattagcatattcggaaaactcacagccaaaagtatccaccagataattatccagatcatctgccttgaaagccagatgggtcagattcgtcttgacattttccgaataatcggagaatatatcagatatatgcacacgataagaaagataaatctgatttccatccagtccgaaacgataaggagcaatctctgtctgaagtaaataggtcagcacaggttccagattcttttttggcagaatattcagcggagaggtggcaaacaaataagaacggtcgtacacaaacatacgtatctccgaacttcccttatagaatttccagccttcatatcccacacgtgccaataccggattgattcccatcgcttcaatggcttcttcgcagaatacagccagatcggtcagtcccctctctttaaagatttcttccggcaacttgtcaccgcaacaagggcaatattcatcttcttcggaaatgaattcatcgcaactattacactgcacattaaaaacagagcggtccagactttctatattctccagtacctttttcagtgtatccacagggataccaaatcccatattatccgcatcggtgatcttactggcggtaatggcgatcaattcaccacgttcattgaacatgggacctccgctatttcccggattgaccgcagcatctgtctgaatataataactgttgttaatcagctgtctgggagaagaaaccgtaccttcagtcactgtgaacggcataccaaacggatagccggccacgtttatcttctgtccgatcgcgacttctttcaactccgataaccggatatccggaagagcagaaaaatccccttccaccgacagcaaagcaatatccaatacggaatttaccataacgaccctggccagaaacgaattcttatcattatcctggatcgctacctgacggaatccctctactacatgataattggtaacaaacagatcatattgtttcagataaaaacaactgccgcagccaccggcatgattcactttataaatggcattgtatatattctgttccatagtcttgttctttatttgttagtgtcctcttccgtattgttattgttgccatacataccggccatcatcttttgcatattctccatagcaagttgctgcatcttctgtatttgctccatatcgatattctgcatcgcctgctgcatcatttcctgttgcatctgttgtagttgtgacatgtcgaagcccattatttctccgtcttcgtcaccaccttcttcgtcatcatctacatccagttctccttccatgatattgtccatcgcttcatataatatcggagcagcttcttcccatgacatggcagaggtagccttcatagctttcgcaactaccgcattcacatcattctgcacattattataatagtacaattcatagaacttattaataataagcaagcagcaaacgatgaagtcacctgattccaatgccgagccagctttctcgtatgtatcttcaaagttatcctgaatgtttttcagtacggaacggcgtctgtccgaaatgaaagtttcaacaaagtaaagatcggcagccagttgctccttcgtcatttcctgaaggcgtgtgacaacagatttggtacgggatacgatctccggcaatggcatatcctcgcgtccgtgatctgtaatcgctttatcaagatcattcagcagttgcccctgcggacagacaaaatagcatattttaagaagcgtactggataatatattccaggcataaccatactttcgttctgtctcaaagtattttacagcgtccatacattccttgcaggtctgctgaagagcttcgtataccttatctaccgtttcatcatcgtatggagtaattttgggttcataaatacgctcggccttgaacttagtcacaaattcatcatcatatttatctcctatccggcaaatttcctcaagcacatagtatatcttgtaaggattacataaagccaccggacaatgaaagtcaaagaacaacttatcattctgcaaagagatacatgctaatgtcagttctgtcagattcaaagctgccacctgccgcagcaaaggtatccttcccttttccggcagcaacaaaaacggagctgtaatattcagttggtcaccctccagcttcagatagaccataatggaaccatgaggcacagcaaactccgttccttccgcattaccaaatttgctgcgtaactccggatcaatataatccagcaacagataaaaagactgtaagtgctctcccttttcaaaagcatctgtactcttctcaaaagcttctacatccaccttgctctgtgtagaagcaatgatcggactatgaaaactcagtgtttgtttcataattctaatgtttggtttaacaaattatttcattctcattcttaatcatttaaaagtcccgaagcacagcctccaatgtcgtttcctgcgctatccccatcttttcggtacgaattcttttcagtcttttcttcaccgaatctttctccagatgcatgatcttagcaatatcagtctgcgaaaactgcattttcaccatacagcaataccgcaaatcctcctcattcagtgcaggatactgattcttcagacgttctgtaaaattcaggaagatactgttggcattcttgaatattactttccagtcctcattcttgagcattatattctgctgggtcttcggattttcaatcacaggaatacaagtttcattcaggcgcttaaagaactcaacctttagtaaagcctctttctcccgaatctgcgcttccctttccttagcttccgacaagtctttttctgcctgtagtttttctatttcacggtacttcaacaactcctgctgatgagcaatctgtcctttctgacgcaatacttcctgttgtttccttttatataaaaagaagtagatgcacccccctaacaaaatcgccaggcaacaaacaatagtcacaacatacagttgcagcttcctttctaccgcctgttgccagagacgggtattagcttttttcaattcatcattgtgataattccggtgcaaagtcagtaagccttccttatctctctcctctatgagcctatcccgcaagtcagcatgtcggttcatataataatatgccgaatccatctgcccggtagcagcataaatttcagccttagccaaagactttcgagttgtatattgtatatctgttgtatcttccaccgctttattaatgtagtagaaagcagaatcatactgatgcagttcagtcagtgtgtttgccttatttatataatgatcatagatatattcattttcctctccgaaaagttcaaatagaatagccaaatctttatcgcgatacatcaacgcctgtttatagtccttcatcgccatgcaaagatgggcatgctgtgaataaatatgtgataatgcccggaccaagttctctttctcagccagttgtatcgcttgcacagaatatttataggcgctatccagttgatttgtctgcataaatccgtgagtgatatacggcaacagtgcacagatatacaaagggttgcctgtccgttcggcataaggtaacgctgccttccccaaccgtagttcctcatcaggaatcagtcgcaagttgaaaagacgactcattttatacctgaccatgaactgaagttcatcgttatcactctctcccaaccaatcgattgtctttaggaaattatgcagggaagcttccgaatcttcattatccattgctaccagaccggcattataataagccagtgccgcatgaacagagtccgtggttcctttataataatcaattgcaacagatataagtgaatcacttttatgctcctcatcagatgactgattgatcacctgagtcattagcaatgcatacaaagccctatttgaatccgacagcttctccggatactgaatttggcgaagtaaagaaagagcgctgtccggtttcagcttgatcaattgttcgatagataacaatcggtcggctgtatgatgacaagcagtcaataagaatcctaacaatataaaaagtacagtttgtcgtaaatgcttcatgaacaaaaggtttatgtttcccaactaaagagacgaatctctgaatgcaaatgtaggaataataatgggagttgctttataaaatagggggtataaatatattcttaattaaatcaaatatttgcctgtttatcaaatcaatatagtatacagcaaagggggacatagggggacatttactgttttataggggataatcgcaatatgaaaccactcagaattcaataaaattgatgtaccccaaacaaaagaaaaacgttgactattattaaataatcaacgtttacatcagtgattccgaagcgattcgaacgcttgacccacgccttagaagggcgttgctctatccagctgagctacggaaccatccttatttgcggatgcaaaggtagtgctttttgcgagaactcaaaaacttttcgacacttttttattcatatttttctttatagctagaaatcagcaatttataaaagtactattcagaaccctgttctagggttgaattattttttcttatcccgatatcccatatatcatatatcttatttatctttgtgcctgtcaaatataaaatcaaaaactatgttgagtcgtattatcgtattggtcatagccggagttgctgtcgtttatatcgtccgctttatagataacttcttgtcccagcacagaagaaaatattaaataagatatatatccaatcaggagaagttcatttaaaacttctccttccgttcaaattcaccttcttcggtgtaatacttccatgtgcctttaggctgattatttgaatatttcccacgaagcttgagctttccattttcgtgatattcacggtaacgtccgtgacgttttccctctttcacttccgcttcgcttttcaatgctccttccggatagaactcacgcagaacatttccttcaaacttctcaatatagaaacgctttaactcactcatctgctccttttcggtcacagcttcttcatccatatcctgatcttcctcatcgctgacaacggccaccacctcttccggctcgtacggacggtaatccatcacatactgcagagaagcttggttgttatctccgattacctgcatcgtccagtaaggaaatgaatacaagatatctttattcgattgtatttcattccatgtagcgggattcatcataggtttcaattgtgagtagaacttgtgcatatctgtatacaagaagattgtggaacttgatttcatatacgaataagcatccttaaatcctgcattattcttcagtaaattcttctgttcgtaatcttctacaaaggaaagcaaggaagccggtttattgctgaaaacgacataatcatccacataagtataatatggcttctcaaatttatcaaacagctttccgaagaacagacggaagaaacctttcatttcaacataattgatttcaaagtccttataattaacagactttatcttaaccggagaccggcgtttgatcttcttttcaataaactccatattcttacgggcgtctttgatgctttttgcccgaatagccagaatcacttcaggatcatgtcctaataagcccggttcggattgcgttatggcaaactctccggacatccagctcaggaagttctcttccagagaaataccaaacaggctttctatctttttccgcgaactctgataagagtcatacaacagtttatcatgaacagacagagcgttctctagttccttcacgaaagttaccggactatcgaagccgatatttgtataaagagccgttcgcccggacaaaatctcgtgagctttcattttatgctttcccgaattcagcaaggcagtgatataaggatccaccgaatctttcttcaacgtataacctttcacttccatccggtccttatccatattcaggtaaaggcccgcaaaattcatagaattactgaacagatcgacatattcatttctcgctcccagataaatggacataaactgaggaatacgggcatagttgataaataccctgacaagccctttaccggaaactaatttttccgtttcaataaaagactggtcaagtccgatcttaggcttattacgggagttgatggcagattcaacaaggccggaagtataagagcctaccaggtgattatccacaaaagcagtataaaagacatcacgggtatccggatcacgcatttcaagaatgttaattccattatgcattcgattagtgacggtaaagccggacattgccagcactgtttcgacctgatccttcaataaatccattttagaagctttctgcatatctactataagcagaaaatcccaatcggtagcgcgggtcttatgaagtgagataagcagatcccgctgaccgaccagtgataacagtactttattgcttttgacaaccgagtcaagcttttccacgctcttcgcaacttcttcaaatgatttcgcttttctcagacattgccaggtttcgcttccactaaacttttcccagtcttctatcggagcagatgactgaatgataaacgctgcatcctctggcaccagatagatctgctgaatattacggtcgggcgaaataaacagataaacgatggagtataccatgtatacagccaaagctagtcctgccgtaatcaaagttctttttacaatttttcgtgtattatttttcttctcatttttcccgggttcgacatattgcccttgttccccattgtttaattcatccattatttatttgttattgagttgattgggcaaaattactaaaaaaaagatggaagatgaaattcataggtcggtttatactttaaatcttctcatccacctatatccgccacagatcacaactactccatcttcttagggaatgaaaggataagataaaatcgtgcgcagatgaattggaataaagttttttaaacaaagacatctgcttaaaacaaaaaagggacaagaaaaaaagtagaaaactaaaataaccaacttgcatactattagtgtatattcatcaccttttaatacatataagtacattattatatcacatatttatatttttattttaaaacacaaattcatcattctatcttacatctataaattccaaaatttcatttacaatatactttgtgttaacctaaggcaattatacaactttcagttaattaataaacaaaataaataattttacaacaatctaccaaataaagcaaacaaaatgattgttttcatgttattacaagttacatttacttcgtaaatacaatttcctgctttatcagaagggaacaaatgtattttatttgatattaattcatgattgagcacaaacaaacagctattgagacatcatggtccgatagcatacataatataagatcgcctcctcccctgattattcacctgaggctagtttattatgcctaatacaaataaatgaaaataattattgttacttgggggactttgcttttttattgatagttcaagacatttagaaattgaattttcaataaacataactcatgatcaatattgacctcccaaaaaacaaacaaatttgagatcatattatttgagtttatagatgtgcacaattatgaaatcatagttggcatataatctactatgtcttttgaattagaaagaaaaagcaaactctttaggagtgacgtcatttaaaatataacaacatgatgtatttaaagacaatatctattgctgcatctttcttaatagcaacaatatttgagaatcaatcatacttagttttattgttgattgtaataagtttctatctctactggcatttatttcattatctttccatacaaaaagaaagaaatttcctcaaagaagagaaccagtattttatagattctttccaaagtattcgaaatccaattaccttagtccatgttcctttacgaacgatctgtagtgacacctgtcccgagaatatgaagaatgatttattactagctattcggaatatagaatgcttaaatgagaatctggacagattgtccggattgaaatatttgcataatcatcccgaagccatggacattaccgaacatgaattaggaagctatgtaagaagcagaattcaatccctacaaggctatgcaacgaataaacacataaaactaatcatcaatacaaacttcacctatgccagtgtatggtttgacaaaagcaaagtctcaccaattatcgataaattcataactaatgcaatcgactgttccaaaccaaaaacaaacattacattactgatttctatcagtcaggaacattgggaaataagtgtacccgattcaggagatggtaaactgacaaagctttataatcaaaataaacatcggttgatgagacagacaacagaatttgaatgcgattttgcaaaaagcatattatataagaaactaacgaatttgtgtaatggaaaaatcatagtaaacagtacatatcatactgtcacattaaagtttccagtaaaatgctcttgtaaaaaccaattaaatcattcggcattgagtatcaccaatcatactgagattgaaaagatagatcgtttgctttcaaaggctccctgtaaaagaagttctcacaagccgacagtcgtacttgccgacagtaatgatgatttccgatcctatctgacaagttgtttaacggaagagtttactattaaaagttttagagatggcatcgaagcgatggcttacataaaaaatgaatatcctgatttagtgatttgtgatacagaacttcaaaacatggatggtgtcgaactctcatcaagattgaaaacatcttgcgaaacatcaatcatacctatcatactttatagttcgcatatagatattaaccagcacaatagaagaaagacttctttagccgatacattcttgcaacagccctttagtgtaacagatttaaagcttgaaatgtcaatccttatcaaaaacactcgttttcttcgaaaatcattcttacaacgattatttggagaagagtttttggagacaaaagcgtcagaaatattgcaggatggtaaacaccctttgataagtaaagttactaaaatcattctggaaaatctgaataatgaaaaactaaccatagactccattgccaaagagcttggaattagccggacaagtctttacaacaagtggacgcaattaacaggcgaagcacttaacaaattcattctcaaaatccgaatggaaaaagcgcatgaaatgttaaagagtggaaaatatcgcgtaaacgaagtcccagagaaaatcggaatgaaagatatggataacttccgcgaaaaatataagaagtatttcggaaagacaccagttgatactattaaaaacgtttgaagtatttatattgaaaagcagttttaaataaaacaacctgagaccgatagaagaattgttgacgcaatcaaccaaacttctttttatcgggctcaggtacctttccgacacgctattcctgaacgaatttgcctatatagaaattctcatcttcattgaccggtgtgtaataaggaacccaaaaattaaggaaaccataacgaacctcttcattagggaaagccaaacgataaagttgaaattctttgtcatagtccttgataatcagctaacctctctgataaatcaatggaagcggattgttggcatccacccgatattctataaataaaattacccaaagcctgcaacagaggtttatcgtattcatccaccaataccactactccgcaaccagactgctcattggcacaacgaataatatagctgaatcgttcctccggactacgatcttttttctcatctccatatataactttcgattttaatatagttcatcaatcaatgcttattgcatatctcttcatccacctatatccgccgcattaaccatagaaaaggaaatcgaagtggaaatgagagcggaactctatgaatttctgctggagaataaattcaaaaacggaatcatgttcaaacgctcaatagagctttttgtggaacattataatatggaaggtacagtgaaggaagatagcctgatgagggcttttaagaggtggaggaaggcgatgaaagataatagaaaatactaatacatctaaaaaaggggctgtccgattttggacagccccacataaaaataagtcttatatttaggctgcactaataaagctacctaaatctttatatatttcctctattttaataaactactaccagagaactatctgtccgattcatcatctctccaatgttcaggtttgttcaactcatccgaacacctgatctttcctttatccacatcaaatcccttcggactgattgcctgaaccatccaataatccgagaactgttccagtatcgggtaaggagcaggataacccagcctggctgcatccggtataaaaccatattctggataatattctttatgccccaatacaaacacaaggcacgaacctttttcctgtaacctctctatgcctgcccgtatcagcattccgcctataccctgccgttgatattccggcttgacagctaaaggtgcaagaatgtgcatcatctgtagtgctccctgaccatcaaaataggctctggtgaagagaatgtgtccgacagcctcacctttgtagaaagcgagcaacgaaaccattggttctgcggttttgtcagccagcaggtcggctaccaactgtgcttctttgtcatagccaaacgcttgtttttcaacagtcattatgctgtcgaaatcatctgtattggtctctctaatttgtatattaattgaatttatcatttcattgtttttttgagcatgtatatcttgcagatagttattatccgtcttatagacatgcgattatacttattatatagaatatgaaaataactctggcaagaatatgccagagtatgaattaagggataaccttgacagactgccaaaggttatttacttcacggactccttcttagctttacacatagaccgcaaaggtaatgctttctattgcattatgctatagtttgcagcgaaaactatccatcaattttacttttttattgatagaaactacttttatttcattctctcccggctgcaactccacatttttccattccaaaatagcatactgatccggcattgccttaccatagctttttccattgacaaacagttccgccccgggctgattagtgaatgcagtaatcgtttgcagacgtcgggaacgtacggtgttacgttttccggccagataaagcacaggttcttccttgttccagttagccttataaaagtagaacgcgtctttacgtactttccggtcaaaggtaaccagccccttatcattaattcccggacgatcaccttccgtacggtgagccgcaccgaaatcaaacatattccatacaaagctaccccatatataaggacgggcagaaatcgctttccagttctctatatgataataggtctgccagttctccggatgccaccaactgtttggcacggattttaccaacgaatcctgctgatgataaatgctggcaccggcaccatactcactaatggcaatacgaatttccggatgatctctatgcataccgtccagccagcgtcctaaatcggccggggtgcctccataccatccgtcgtaccgattccatgcaatggcatccgttatgaaattcaagtcacccatttgattacttgccgaagtggtagggcgggtagtatcttcctgatgcgccagctcatttaattccttgatatattccaccggattatcaccgaattcaagcagttcattgaacagcccccatacacagatggaaggatgattaaaatgttggcggatcagctccttcagctgttctttcccattggcacggaaagaaggcagattaacaaatcctttatcatcatatcctccgggaccgataaaaggtatttctgcccagacaataatcccattcttatccatcagatcatagaaataggtagcttgcggataatgtgccagccgaaccgcattcactcccatttccagcatcagggctacatcttcttcatgatgctgaggacgtaaagcattacccacctcactcctgtcctgatgccggcaaacaccgtgaagaggcagatgcttgccattcaaaaagaatcccttatccggatcaatccgataataacgaagtcctaaaggctgcgtcacacaatctaccaactgccctcctctcgacaaggatacctccgcctgataaaggaacgggtcctgacgaccattccacagatgaggattatttatctcaaatgtaagttcctgctgcaaagctgcattcccggcaagagtaagtgtctgtttctgttgcgccaccactttctgaccatccagcaaacggacacccagttctacttcctgaccggcattattgccatttgccaaatcaacgaccgcccttactttcgcatattgatgactgacactatcctgtatcagacgaactcccggagaagcataattcaaaggagaaatacaagcctcatcagtgatcagcagatgcacatccctgtaaataccgccataaaaattaaagtcacctaccaaaggcatcacgtccagttgttctccattattcacccgcactaatatagagttctcttttccataattcacctctccggttatttcaaagacaaaagctccgtatcctccacgatgttcgccgatatgacggcgattgataaatacatctgctatactgttcacgccttcgaagcgaaggaaaagacgcttgccttgccattcgggacgaataaacagcttcttttcataattaccgattccccgtttatagtcgatctttccggacaaagcatcctgcgcattccaggtatggggcagatctactcttatttccgaccctttctgcacctgatgcgagaaccggaacttccagttgtcgtttaataaaatatcctgccgctgagcaaagagcggcatactgcaaaacaggaataaaacagctgccatcaagcggcagcatgacataattggtgttctcatattatttctttaatgatgatttcttcactttgataaaagaagagagtgattcaactttactcttatattttttctcattgactctatttttgttttcttctttatctatccgatgatcgaacagcatacttgctttcttcacgtcccctttcatccattcggcataactaaaacgttgatcaaccgcattgtctcccccttcccactgaatatagacttcatccttcgtcttagccttcagattgctgaaaacttttgcaaagctctgtccatccaactgttctgctggttgtggtatctgacataactcgcacaaagtaggatacaaatctacaaactcaaccatcgaccgggtctttccttttttccttccgggcacacggataatcaacggcacatgagtagaacggtccatcagattatgtttacccacaaaatcatgttcgcccagattccagccgtgatctcccaacagtaccacaatcgtattctccgccaggcctaactcatccagagcgtccagcacttttccgatttgtgcatccacatagctcaggcaagcataatatccatgcttcacttcccgctgaaaatcagcatcacttgtatcagacacccgtgcataagcatatatctcactcgaattacggacttgttccggcaagccttccggtctgaaacggttgggagccaaaggtatctcttcccgcttatacaaatcccaatatttcttcggggcattaaacggcaaatgaggtttccaaaatccgcaagccaggaaaaacggcttgttcatttctttcatacgccgcaggtcgcgaatggcacgttccgccagttttccgtcatcgtatgccgtatccggaacatccgctgactcgcaaaacggtccgcgcatagtcttgggattgatcgtcttgcctgattctgagttcatccaaagttcccatttattatattccgcccaatagacatcgtatccatccggatgattccggtagggaggttcgctccacgatgcagcatgatcgctcatgtggtgaaaaactttgccatccgaaaccgtatgataaccattctttgtaaaccatccggaaagaggtatcgcctccggacaatccttgctggcataagccgagaaattcacaaaacgatcgggatagtgaggatatacgcctgtcaagaggctggcacgggaagcgccactcaccggaacattgcaatatgcgttctgaaacaagactccgctcgatgccagacgatccatattcggagtcttgaccgcctccactccgtaacaacccagttcgggacgcatatcgtcagccatcagaaaaagaacattcattctggaaacatcggagacattgcgctgcgcctgcacagcagaggccatacagcaagctgtcccgcaaagaagggtatattttaccgaaatagcgttcttcattttatagtttaaattttcaagacctgcaatatacaaaatattacaggtcttgcctctgtttttactcaaaaaattatttagtccataccggattctgttccagattcgtattcaatgccagttgcttcagaggcagcggatacaggtaataatgttcctgccatccgagcggagcgtcaaagaagtaaacatacccttcgtcattactcggtccgccggtcactttcagatttttagccgaagctcccgtcacatatactcccaacgggcgtttattgacatagtctccttttttccatctgcggaggtcatccagacggaatccttcccccatcagttccacacgtctctccctgcgtacctcccacagaagagcaggaacggaaggatcacgggccgtatcaaaatcatctgtaatgtcttcgaccgtcattttcgctacatgtccacgtgcacgaagtttattaatggatttatcggcagccgtctgatcaaacttacctaattcgcacatggcttcggcataattcaccatcacctctcctacacggaacaaaggcgcatccgttgtattcactccgttggcattggtagctacggtatgcgtattataatacttccatacccagaatcccatttgagaagcattccagccctgtccccaattctgattcttgaagtgcggctgtccctgcaccgtaaatcctttgaagttggaagacggcaaacgatgataagtctcaccggagatcgtagcaagaagatctataaactctctgtcctgcgcatcatccgtatatttccagtcagccgtgctcggaccattttctttctttaccatatagggaggacatatcgtcagatacaaccggtaatcacggtcgcggaactgtccataaatctccttatcaccgccataccgactggtggtagtacttaccggacgaccatccgtacacagataactgtctaccgcatcctttgtcgcctcaatataagattcaccagtacgcaccatgcgtgtcaggccatgcatcaactgaccggtttcataggctttatacaagataatgcccgtcaccccatccaaagactccgaattgaaaagctcatcatactgtggatgtacattcggataaaccttcaagacttcttccgacgcacgtacacattctttcaagtaagtctcggcatcagacaatccatgatatttccgccaagtaccctcgaacaaggcaaaacgggaaataagtgcctgcaccacagatataccaatggtgtttttgccgtcgtccgcaccgatatgtgtctccgcatatttcaaattggacaggatattcgaagccaccagatcgcggttatcccgtttgccgtacagctccggactgtcttctttcaacgcattctccacccaggggatatctccaaagcgggaaagcatctgaaagtatttatatgaacggaagaaatagccgacactacgccagtgctccttctccgtatcattcatctgcgaaccgtcgatattgtccagcatcagatttacccggcggatatagtcgtaatcccattccttggcttcatctgtcgccttcgccttctggtatgcccactgcccttcatatccggacaaacccttgatcatattgtccgactcaaaatctccccggaatatttcgtccgtctgtcccgtatcatacgtatatccgaagaatacattatataatccccatgcatacgttttaaagttatcataggtagtaaagactgtcgcttccgtctgttgtcctttcggataaacttccagaaaagagtcattcaaacaagacgatatcagcaaacagagactaatgcccgtacccagtatatatttcttcataataattactcttttaaatagtgaaacaatcagaatgaaaggttgataccaaacgaatactgccgcatatacggataggtaaaaccacgttgtcccaagtcatccgttaccgaacgttccggatcgagtcctttcggcaaatgatcgaatgtataaagattctcaccgctaaagaatacagccagattattgacaccgatcttattcatccacttggacgggaaattataagataaggtgatattccggatactcaggtaggaaccatcctgcagataacgggtctgaatacgtgtattggcagcagtatttccggcagctttctcatacagacgggggaaatagctgtctgtgcgttccggcgtccagtaattcagttgtgtgtcatataccgtcgtccatgcatcatagtgaggatagaacaagtcattcataatccacaaatcacgtttgcctactccctgcaacaggaaagataaagagaaccccttccagcttgcaccaccgtggatgccatactgataacgacgggtactattaccgatgatcttacggtcgcccggatctttcgtggtacttgtgcctccgttgataatatcgttgtcatccaggtctttatacaggatatcacccggattcggattgtagccttccacttttggaatgcctgctttcagcttgccatcggcatcaaaatcatcaacagtatacaggcggtcggtaacatacccccagatttcacccagttccatacctacacggtaagtatctttatcgttcttatccttgccgaagagacctgtctcgttattatacttggtaatcttggttttagcatcataaaggttgaagcccagattgtatttcacttttccgatctgatcattccagtctacagtgatctcccatcctttggaacgaagatcggcagtattctgcaaaggagcacttgcacccagcacagccggtaattccgctcccggagcgagcatacctttcgtatcacgacgataccagtcgaatacaagattcagcctgttgttcaataaacccagatcaaaaccgacatcgacagtcgtcactttctcccaggtaaaactgttactgaccaatgcagctggtttaagggtagttaccttgatacccgaaacggtccagtaagcctgctcggcatccatgcccggaatataagcgtaaggagtgatactctgattgccaatattaccccacgaagcacgcaatttaaagttagacaatacggatgtcaacggtttcataaacgcttcttcgctcacacgccatccggcagagacagaaggaaagaaaccgaagcgactgtctttcggaaatttggaagagccgtcatagcgtccgttcgtttcaatcagatatttgccggcaaaggagtagttgatacgatagaataatcctcttactgtatagcgttcgaatttatctttagcgaaataatctcctgtagcctgcgatatagaaggaaggtcttcgttaatcatgttcatacgcgacatttccgcatagcgatagtcactgctctcctgattgaaacctcccatcacggtgacttcatgcttgccccatgtgttattgtagtttccgtagaagttcagggcattataatcggtaatgccgttggagttttcatacttagagtttgccgtcgaagtctctttcacaaagttacctccgtgggcataatagaacttcttttcaaacttggtcttttcattactcagatggttgtatgtatattcacccaccagtttgacgttcttcaaaggagtaatcgtcacctttccgaagatacggatattgtttttctggatagtcgtcggataagcaagattaatcagattccggggagtattaatcggtagttcttctccgtcgatattcattgttccggtagggaaataagacgggaaggcaacggctgctccccagattccatatcctcccgaagtctccggcaattctgatttcgagttcgtatatttgatatccagttccggagtaatccatgagaatacgtccgaacggatataagaagacacattgtaacgtttatacgcatccttgtccgaggccagcactccattctcatcgaccataccgaaagagaaacgataagatatatctttcgtgccgccacctacagaaagattgtgcgtctgctggaaaccggtctccatcatatcatcaaacagattggtttctgccagactatagcgcaatccgtccaccattgcatacccatcgggataagccgaaggattggcattgtattcttttaataaatccagccacgtatccacattctgtccactctgatagttgatggttcccatgtctttataagcctgcaccgtctgaagcggtgttgccttacgaggcatattggcaggtctgctaaatgagaaattgttagaataattaatagaaagcctggttgaatccgatcctttctttgtcgtaatcagaatgacgccaaatgcggcacgtgccccgtagatagccgaagaagcagcatctttcaagaccgttactgattcaatatcattcggatcgagcatattgatatccatttctacgttatccaccagaaccaacggtttgccattcttatccagactgttgacaccacggatattgaaactcatttcctctcctggtctaccggagttacccgtaatctgcaaaccgggcatcgcacctttcaaggcatcgctgaccgacactaccggacggtctcccaatacttcatccatcttcacgctgcttaccgcaccagtcagattcgctttcttctgcacaccgtagcctactaccacaacttcgtcaatcagacggctgtcttctttcagagcaatgtgcaaaggagtctgattcttgacgacgacttcctgcgtagcatatccgatataagacacggacaaacatgcattcggagtcaccgacagagagaagtttccatccatatccgtgatcgtgccttccgtagaattcagcactttcacattggcaccgatcactccttcacccgaaggatcggtcactttgcctttcaggacaaacgcttttccctgttccttttcaggcactgcggcatggaatatgaccacccggtttccgtttacttcataactgatccccgtaccggtcagcagttgggccatcaggtcattaatcgtacccttgtccacgttcacagagactttcttattcaggtcaatgtcgttattgcgaatcagaaaagaataatttccctgcttcctgactacttcaatggcttctttcaaagtaacgttatctgctttgacactgaacttcttgttttgttcctgtgctgaaagttgaaaacctgtcaggacattacttagggacaaaagcagaaacatcaataatgtttttcttattatcaatctcatttttatcactattaaaggttaacatatagttatttatcgtagctgcggactgccgatatatctatcggctgtgtccattttctttctccttccttttatcttaccccctttcttttatcggtaataaagatggtgtcaccactgactttccacgtgtattgtttctcaacgttgatttcgtgtaatatatcataaatattctgattgctgtcgaaggaaccggagaagtgttcggccttcagacgttcgctttctatgctgatcttcacctggaatttacgttccagacgatgggcaatatcagcgaatgaagcattctcgaaggtcaacccgccatccagccaatcgcaggctttacttgcattggtcttcagcttttccattcgtccggtgttcttgttatacagtgcctgctcattcgggaataatttcatcacagaattagcagacgccgataaattcaccctgccttccagcagagacaccatcacataattatcgtcatcataagcacggacattgaataccgtgccgactacctgcacctgcacatcgttcgtcttcacgaagaagggaacctctgcatttttcgcaactttaaagtatccttcgccatccaacgtcacattacgttcgcggataccaaacccacggtgatagcgcaatacagaacctgcattcagagaaacctccgtcccgtcaggaagaacgatattcgttctcgatccggcaggaaccttgatttcgtaaggagaatcggcgttggtatatacttccgtcagattttccgtatacgtataccagaaatagttgcaaccgatcagcagaataacggcggcagccactttcagccagacaggtatcagtttccggacaggcttcgaagaggcaggagcagtcattctctcctttatccgcactaaattggagttttctatttctgcaaacgacggtacggaagaaagtgcccatacggcagacatttcccggaaagtccgggcagctgcttcattggaagccagaaaggcaagcaacgtttctttttcttcatcggtactattgcccgacaaataattactaatctgtaattccagttcttctttatcgtaatattctatcataaaccgttctttttctatggtgtatataactagatacgcaataaaaaaagaaacgtttaaaagaaaaccgattttttttaaagaaacatcaaaatagctatcatatagggagtaccaagggattcgcgcaatttagtcagcgcaattttcatctgcaccctgacggtggcgacattaatattctgctcttccgcaatttcgctgtacgatttgccttcatacaggctcgccttaaaaacagcacggcatttggcagggagttcctctactttccgcagaatgatctcgttcatttcactgctttccaatgcctgcaatggattgtcggaagaaagaatatgattttctagaaaagcccatatttcctccatctgttcggtcattatgcgctcgttaaaagcggaagaccgcaaataactgatacttgcattctgtatagcccgacgaagatacggaagggcaggataagtgatatggtggcgattctgccagaaagagacgaagacatcattgactatttcaccggcgactctcttgtcatgtacatagtaaacagctatcgcacacaggtataaatagtacgtatgataaattttatcaaatgctttggtgctaccgtgattcagttgttcgattagtttttcagagacttctggtaaattcattcgttctttttctttaagggacgggtgcaaatatagcgattaattcagaaactcaaaattccggttattaaaaccggaactttgaatcgtgaattatagccccatcggtatcttcaacagataccagacgataaacagcaacgtccatgctgccagaatgcacaaggagtacctccatgtatatttcagcaacgatccgtatgtgatctgtttgtcatattgccgcatatacgtcaacaccagcggcatatagaataagaaaggagtaatggcattcgtcgaactgtctccgatacggaaagcacactgcgtgacgtccggcgaaatccccatctgcgcaaacatcggaatgaagatgaaagacataaatgcccatttggaagtggcggataccataatcagattgataaacgccgtaaacaggataaacaagatgagtgcggacaagggagccggctcaaaagaagagagcaggtccgctcccataatcgcaagacacttgtccagatgagaatactcgaaacaggcaaacatctgggcagcgaagaaagcaataacgaaatatacacccagcagtttgatcggctgggtaagtccttcaatcacatcattatcgctgcgataacgaccggagctgaatccgtaagccatccccgtaaaacctgcgcccagagatagcagaaacaggataccggctatgaagggcgagtgcatcaaacctccgttaacgccacgcaggataccataggaggagaaagtaagccacaaaataagggcaacgtatatccctgccactgtgacagccaccatcagcgcacgacgttctttccgtgacaaagggcggtaggcttcgactttcacactaccctcatattttcctaggttcgggagaagccatttttgagtcacccaataaacgatcccggtaattaccactgtcgaagcactcataaagaagtagttgcacagcggctccgtgtttccctgatatcccatcagtgtgagcgcggcttcctgagtggtatgcgccaagagcgggtccatcgtactcagtacgatattggcactatatccgcaggccacggaaacgtaagccgtcacaatccccgctatcggatgaagtcccacccactgaaacagcatggcggcaatgggaagcagaataatataaccgccgtccccaatgacgttcgacagcaatccgaggacaatcacccacaggataacttttcttttctctttccggtttcccactcccagacggatgcacgcatcgataaatccggaatgttgggccacccccagtccgaacatggcgataatcaccatgcccagcggagcaaaaccggtaaagttcttgatagcattccgcaaccaccagcggattccctcaggactcagcaggctttgcacccgaatatcctcccctgattgcggcagcgttactttcagtccgtagatatcacatatccacgaaagaaagaccaccgccattgtcagcagcagaaacatcgtagcgggatgcggcatacgccatttactcttcatcagcttccagattatccagatcgataatgcgtaattccaatgcacggacagccagacgggtcgcgttcactcccacccgttctccattcgggaagagacgtccgatcaggtcattctgtcgtttctccagtgatttcacgccgaatggcattcctttcagattggcaatcatatctttggtgtagcctaatgccagatggcgaagaaaacgctcgtcatattcatcaatatcatagttgattaccgcttcctgacgcttggcatcattcgctaccgacttcttgaaacggtctacgatcttctccagaatcggatagttgaataccagcttcttgccgtccatcacagcttgtacatctgtcttggtcagtaattctcctgttttaagaataatgccgtccgctcctgcattcagcacatccacccacagtttttcattcagtatttcccccgtaaagatcaatacacgaacccccttgtaacgtttgaaaatattccggcagatatcaacgccaatcgtcgtagaacctcccagtcccaaatccagcaaaaccagatcgggaagctgtgcctccatcagcggccagaactcgctttctgtcattgccgtgccgatcacttctgcgttgggtatctcatgacggaaaatttcttctgtgcctttcaattccagttttacgtcctctacaataataactttaaacttctgttcttccattttatttatctaataacttttatgtgtcttctttcttatctgcgcgggatggtgaagtaaaccgtaaatccccccccttctgccggttcggcattgatacggcatcctctgcgccccgcaaattcatcatggtcacgaataatctgcttgcatatcagatattccgttcccctcaactcccctttttcgccggaagtcatacgagccaggttcggatagaacaactggttcagctccgtcacactcttctcgcgcctggtatccgtaaaaaggaaacggatatattcgttatccttacgagcctgcaagcgtatcactccttcttcacgaaccgccaatgcttcatcaatcagattctcaaacaggaaacgcaactgattcacgtcaccgatcactttggcgtccatcggttctatgattagttctaccttttccgtccgatttttcgtgaccttcctgaagtattttccagcagcatcaaaaagctcctgtaccggaatcgtattccggcggaaagtaacctcctccagctgtcgagcagcgcatgaactcagaatcgtaaagatccctttataatattctatcagttctgtaatcgtttccacagcttcccgttcatccttttccggaaggttctgcgtattcaaccgaccaataatctgtttaatcttgttcggataataaattgtctcatgtttaatcgtcgaaaggcagttatcaagcaccatgttctgcacatgaagcatactgtcttcccacgaagcacggcgtgtttcctcgtgtgccgactcgatatcccggtattgcgtggcaagctttaccactgcattgaacaccacaatcgatacataacgtgctaccagctcaaaaagaagatgatccgtttcttgttgcgttccttccctccgttccagataaagcacacctacacattgatgctcacctccggcttccaccatcaacggaatcgcctgcaaattctgttctgagagatattcccccgtttcaaaacattgctgcaccatttccggcatttcctgtccgggacaggaagcatattccagccgatgcgtggtttcgttataaactgcaatgcccatcaggctgattgtcagcaactcatttactgagccaaaagcctcattcacgatgcgctgcggaatctctttaagtgtattttcctccctctgaagcgcttcctcgttctcctgagtctgaggtctgaccaaagaggcggcaaaaactttctgatttatctcaagcacctgttccaggttcagacggttctgcaacatcttcctcatatacaagagataatagccgatcagagaaacgatcagcaagacgaaacagaggatgataccaaccgtcttattcgtgttggatcgttccaactgcctgcaatatccttccaaattttggtcttccccctgtactttatataaatctgtatatgcagcattattataactatatgcgtccagctcttttagcgcaagaaaagccacagccgcctcatttcgtatatccaaaattacatgataatccgagtcaaaatattcattccaccaccatatttctgcagggattccttctcctacaagtttcatatgccgatgtggctgattagaatgcgcatatttctcataatgttcattcagaaacatcatcgctgtatctatatattgcagagcaagctcataccttccatgtacatttgcagaataagcagtatcggcataatatgatgctatatcaagcaattcttcataaattgaatctgttataataacaattgaatctttattttgcaaaataggtgatgtcggagtctgcaaacaagagccaaaccctacaggcaacaacaagcaaagcaatacgccaatcactttacgtacccccgaaggtagacgaaaataaaaacggcttccttttcccggttcgctttctatatcgaatacgcatacccggaacagttcatttgttttcttatatttctctatgattcccttgcaattcatcaaaccaaaaccgcttcccttattctctttcagttcttccggatctgccgcgtctttcatgccgatagcacgcgaatcatataccttttcaccaatgatatgcgcgatatcttctgctgaaagtcctctcccattatcttctacggagatttccacatacgcgtcagtagcatgcgcatatacttttaccattcctcctccgggcgtatatttacgggcattttcagccagtgtattaatcataaacaaggtcagcgcacggtcagcctttaccataagagttgtcgattcaatttccaacttttgctttttcatctcaaaagcacgccgcccttttcccaacaaatcaaataactcattcaggctgaatgtctcgatgttcagactaagcgtaccttgcttcatcttgatccaaagtgccagaatatcattgtattcgttgatggtagtcaccagttcgtcaatgtactggtacttctctttctttatcttggcgtcatcaatatatcctttttccgtcagcttatgtacctcgttcagaatccggtcaatataaggattgataccgctcacaatggccatacaagctttctttatcaaattctgacgtttgtttcctgcaatatgctgttcgtagatataccgttgcttctccagttgaatccgctcatcgctcaacgcagctaccatttgttcattttcagcagcccacacaatataaggttccaagacgtgtaccagtgctttttcgtctcgattcagccgatgggaagagggcaccagtgcagcttttccttcttccggaatttccagcgtcagacgtcctttcccgaacaactgatcaatgccctgctgaatcaaaggtatattcatcggtatggaagaagtgatatcccgacaaagagagagaatccgttgcagacgctccacatccacctgattcctgattttggaacgtttgttgaagaaccaccaaaggataatcaccaatatcagaccaacaataaccaaaaaaagaaccagtgtcatttgccgtgaacctgcttccagtgaaagtttcctgctttccaactccttatcctgacgagtaaagttcaaaatatccagatagatattccggttataatcagaagcatccttcatccccagcccggcatatgaaacgcttaactgctcccttatccgtgagatccattcgggaacggtcttcaccttctcctgtccaatccatggaactccggtataagtagtatctccctcggcaaacgtatataatttatcaagcgtatccacttcattatgataataaagcatgtgatgatggtttacgcagttcaatgcttttgataatgtatccaaagcttcctgataacgtccatgcgcattcaggtatttgccgatagatacataagctccggcaatctgatacaagtcattatattcgcgaaatttctccagtgccagttgggccaaacgcaaagggaacaaagaatctaccggaaaatcaaactgatccaacgcatgtgtacgccttgtcttgaaaaactcaaaattagacggggctgccatcagattggcaagtccctgcattccattcccctcaaaatacggatgcttgctcttcacggctgtccgccaagtgaaataaagttcgtcaaactcgcgaagtttccgttcttccggagtattcgctgcgaccaaagaagccgatcctttgagataatgataataaagaagctgattggtatcgctcaacgcttcgtcttcctgaatattatcgatagaggttatcgcttcctgccgttgctggagatagtaatagtaaatggaggaaacgagaaaaaattcggtaaatgcgtaatccagccgaagcgcttcgtgacggtcggcaaagaggtcgctctcttcacgaatacgcttcatccgtcggagggcactgttccggtaatcataaaattctttgttgagcgctgtccgctggcagattttcatcagtccgatgtctgcaatcaacagctcaagctcatttttagtcagcttgtatacctctttatgatacgcctcggcacggtcgaaatccatattcatgaaagcacagaaccccagattattggaagcttccgcttttcccgacttatataggtttacttgccgatatgctttataggcgtatttgtaggaagagtccagattacggtaacgataagcatacgcttttccattcagcgagtcgataagcctcacttcttttgtgggcaccatgtcggtacacgaaaaaagggaggaaagcaacaatactcctattatatataatggagaatggaaaatggaaaatggagaataaaaagacaggcgataactatctttcattcttcgctcttcattttctgtttttcgtccataattcttcattcttcattctcagttcttcgttcttacttgcaaatctacaaatatttccgataagttggagagaaaattattttttctacaataagtctttctaaataataagagaaattcctacctttgcaggcaaattaacaaataggtaacatctattacaaaatgagcgaaaaagcaccctttatggtattctcgggaactaactcgagatatcttgcagagaaaatctgcgcaagtctcaattgtcctctgggaaacatgaacatcacccactttgcagatggtgagtttgccgtttcttacgaagaatcaattcgtggcgcacatgtattccttgtgcagtctactttccctaactcagacaacttaatggaacttctcctgatgatcgacgccgccaaacgtgcatctgcaaagagcgtcgtagctgttatcccctatttcggatgggcacgtcaggacagaaaagacaaacctcgtgtatctatcggagctaaattggtagccgacctgctttcagtagcaggtatcgaccgactgattaccatggatttgcatgcagaccagattcagggattcttcaatatccccgtagatcacctgtatgcatcagccgtattcctcccctatatccagtcattgaaactggaagacctggtgattgctacaccggacgtaggtggttcaaaacgcgccagcactttctccaaataccttggtgtacctttggtactctgcaacaagtcacgtgaaaaagccaatgaagtagcttccatgcaaatcatcggtgatgtgaaagacaaaaacgtagtattgatcgatgacatcgtagatacagcaggcaccatcaccaaagctgccaatatcatgatggaagccggagccaaatccatacgcgctattgccagccactgtgtaatgtctgaccctgcttctttccgtgtgcaggaatccggattgactgaaatggtatttacagacagtatcccttacgctaagaaatgcgcgaaagtgaaacaactgagcatcgctgatatgtttgcagaaacaatcaagcgggtaatgaataacgagtccatcagttcacaatatatcatctaaatgaagaatgatgagtaaaggataagataaagaaagccggctaaacttgaatttagccggctttcttatttatctataattctttcttttaaagaagtcttcccattttataggttccttttttgatcacctttccgtctttatctgtttccacaaaagggccatctttctttccttgtttgaagaagccttcgaagcggttaccgtctttgtcgatctgaacgccttgtccgtcttccagtccgtctacgaaaccacctttatattgcataccggcaacggttttcagagagccctgaccgtgaggacgattattcttccagtctccttcgtaaacatccccgttactccatttatagatacctttgccttcgcgtttattgtttttccagtcaccttcatacacagcaccgtttgcccacgtgaaggtaccttttccatcctgcataccgtctttgaagtttcctacatatttatctccattggcatgatagtaaacgccttctccggtacgttctcccaaaagataagaaccttcgtagcgatctcccgtatggaaaaaataagtaccttttccgtgctggatgtcatctgcccagtcaccatcgtacttatctccgttagtatattcgaatacgccttttccatgacgtacatcatctttccagtcaccgtcgtacttgcagccgtcgtcccagttcatggtgcctttgccgttcttcttgtcattcttccagtgaccgctgtatttagcaccattcgcccacgtataagtaccttcgccttcacgcttgtcgttcgcccagttgcccacgtataagtcgccattatgataatacatcgttccggcaccatgctgataatcctggaaccacattccgtcataacggttattattcataaaataatagattccttttccgtgttgctgatcctggaaccactgaccttcgtacttctctccatccggaaaagaatagattccgtagccttcacgttttcctttgatatattccccttcgtagacatccccatttttaaagaccgttttcccttttccgttcggtttgcgtcctttcatctctcctgtatagacgctaccatctttgaaagtataatttccgatttttatttctgtagagaatgtgtctttcaactttccgaagaacccacctttgctggtattgttatcttgtgccatcactcctccctgtgcaagaagagtcaaaaaaagtgtagtatatagatatttcctcattagttttactcgttactcattaaaattacagtttggacaaagatacaacttctctcccaaaaagtgccataccggaaagcaaattatgacaactttttaccagcaatgacctcttttaatgtctctttgcacaaatagcgctgtgccaattcctgtatttcctgaggtgtcacctcatttacagcctgcaaagaacgggagaaatactggtcatccagccccgaagtagcaataaaaatccacgcatccgccagcgaaaaaggcgattcgtagctccggcacatttcgcccagcatatagttgcgcaccatcgtcagttcttccataggaacaggctcccggtgtagtttgtctatctcattatatacttcctgtatcagcggttccacgtattcattatccgtttcggtcgagattccctgcaaaccgctatccggatagaacataattccggcagaaatcccataagtatatcctttctcttcacggatattagacatcagacggctgccaaagtatcctccgaacagcgtcatcagtacgcgtaatttcagatagtcaggattctgacgggtaatggtggtacatcccatcttcaccgcactttgcaaagcgtcttcacgctctatgaatattcgtttttcgggaacggcaacgaatgaaaatatcggttttgatgctttcagctgatattgtccgaaaggagtcccgaaagcaccggtcacccggcggatgatatcttccgtcaccttacccgacaggaaaatggaacagttgcccgaatgataatgccgtccgtagaagtcacggagtacttccggtgtaatggcatgataatcctcctccactacaatttgcccgcatggatgctgtgtcccgtaaagcgcctgtaacaggccacggtgtgcaaggaagtctactttagaagtattgaccagatattgctggatattcgtatccaggatggtatgcagttctttctccggaaacacaggttccttaatcatggattccacgacttccagcgtttttgccagatacttgttcaacgagtagacagtgatataagcatactccgacgaactggacagttcgagccatgaaccataataatccagtttctctgcaatggttgccgccgtatacttctgcgtgccttcgcgtagcatccggtttgtaaacagcgcctgcaacttctgcgactgttgccagcgccctccggcaaaaagaatatccatacggaccacctcctgttcaccggcattgacaaccgtcaacgggacaccgttcggcaaagtagtccggacgggagaaaggatatggaaatttttcagggcttgtatttcaggttgtatcgtacgatccataaatcagcttctgttcttcaaaaattcttctgcatgtttcagatcctgcggtgtgtcgataccgatcgtttccacgtcactgatgcctacctttattttatatccattctccagccagcgcaactgttcgagtgattctgccaactccagagaggattgcggtagagcggtgatctccttcaatacttccgtgcgataagcgtacagaccgatatgtttgtaataggtatgtcccttcagccagtcttccttatcggcattgcgctgaaaaggtatgatggaacggctgaaataaagtgcgttccaattcttgttgagcaccactttcggggagttgacattctccagtacggcaaacggttcatcggctgtgaaaggcttcaccaacgtagcaatctgcgtggtagggtcttcgaaacaagcctttacagcattcagctgggaaggctggatgaaaggttcgtccccctgtatattgactaccacatcaaagtcgcccccgatctttgtgcacgcctcatagcagcggtcggtaccacttttatgatcaatggaagtcatgactacttttcctccgaatgcttttacggcagcttcaatacgttcgtcatcggtagccacataagcatcatccaagatgcccgctacttgttcgtatacacgctgtatcaccgtcttcccccccagcatagccaatggtttcgcagggaaacgggtggatgcgtagcgggcaggtattattcccagaaatttcatatctgattgtattttaattcttctaatcctttcacaacatactctcttttcaggtcttccggcttcaacacccggtcatcgaaagagagcaaatcaatatccagactgactttttcttccttcttatcctccggacgacgcccggcggactgctcgatagctttcagctccttgcgcactctttcctcctccgcttccgagaagaacatcgccacctgattggagaacaatgccggacttctgaaaaacaaagggcgtgtctcctgttcagacgtaaagcggatggtaggaaacaaatccaccagtctcctgcgagccagaagaagattctctttccggttgtagttacttccgatacaaatgatacatttatgcacgatgagaggtttaattaaacaaatcgtccagtcccgtttcttcgaagacttctccgtccggtgtttccgaaccggcacaagggtcaaaaccttcgggcagtttaaacgtttccgtctggctgtatcccaaagtcgggtcatcgtagactttcttcatataagttgcccagataggcaatgcggcggcagccccttgtccataagtcattgtaccaaagtggatgtcacgttcatcacctcctacccagcaaccggacaccaatgatggagtaaagcccataaaccagctatccgagttatcattggtcgtacctgttttaccgcccatatcggccgtaattccgtaacggcgaacacgtccgcctgttccttcattgataacggaacgaagcattaccaacatcttgtatgcgctcgaaacactgataacttcttccatctgcggtgcaaacgtagaaagcacattgccgtcactatcttcaatgcgggtgacgaataacggagctacccgaatccccttattggcaaaagctgtatatgcgcttaccatttcaccgacagaaatttcgcagggacccagacaaagtgaaacaacagggtcgatcgccttgtttcgtacaccaaaactatgaatcagccttacaaggttataaggattcagtttacccatcaggtaagccgaaatccagttatccgaattggccagtccccatttcagagtcaccatttcaccataacgtttattattggcgtttcggggagtccatgcctctcctgtttcggtaatcagcgtttgttctacatgacgcacctgatcacaaggtgaaaatccgttctccatcgccagtgtatacagatacggcttgatagtagaacctacctgacggcgtcccaccattgccatgtcatattggaaatatgtataattcggtcctccaacatacgccttcacatatccggtcatcgggtccatcgacatgaatcctgtacgcaggaagtgtttgtaatagcgaatagagtccatcggagtcataatcgtatccttctcacctgcccaagtgaaaacagacatttcctgaggagtatcgaatgctttgcgaatctcctgttcagaagcacccgccgacttcattacattataacgttcggtttgtttcatggctctggtcagcaattcttccacccgcgcctgcggcaatgcccttgcatacggagcgttcttacttccttgtttttctttaaagaacagaggttgcaagaagtcgcctaaatgttctttgatagcatcctcagcgtattgctgcatatgcgaattgatggtggtataaatcttcaggccatccgtatagatattataattcgatccgtctttctttttatttttggcgcaccagccgtacaacggatttgtttcccatgaaagtgaatcttcataatacttctgcatctgccagccgcggtactcgctcttaaccggtttcttggcggtcatcacaccacgaagatattcgcggaaataggttgccagaccttctttgtggtctacacgggtatatgccagtttcagcggaagtgcctgcagagaatcacactccgcatccgagatgtagccggctttttccatctgacgcagtacgacattacgacgtcccagcgcattctcacggattttcggatttctggataccggattataacgggacggattctgacacattcccaccagcatcgctgcctgctctattttcaaatctttgggttcacagccgaaataagtagatgcggctgtctttatacctacagcattattcaggaagtcgaacttattaagatacattgtcagaatctcttctttcgtatagtaacgttccagttttacggcaatcacccattcgatcggtttctgcaacagacgctgcatagtattgcttgccaccttttccgtaaacaactgttttgccagctgttgtgagatcgtactacctccacccgcacttttctgcaacaataatccacgcttgacgatagcacgaaaaagtgccttcgcatcaataccggaatgttcggcaaagcgaacatcctccgtcgcaatcagcgcatgaatgatattgggagaaagatcggcatagctgctgtacacacgattgtttttttccatcgagaatgtacccagtactttcccgtcttccgagaaaacctcggtagcaaatttataattggggttttccagttcttccacaggaggcatatagccaatccagcctttagagatagacacaaaaactactacgatagctattaaagcaactgccaacaatacccaaagaacgtttattatttttcgaatcatgtttcttctagcttaaaaaagatgcttataattaagccgcaaaggtagataaaatatagcatacagcaaacgagtttttgatttatttgatattttaaaaccaaccgaaaaacgaataaaaagagaaaaaaagtttgtattttacattttcttcgtacctttacactccggtaaaacaagttctatccacataaaagataacaaaatggaaaacagaagtttagtaaccattgccgaacattctaaagaaaaaatcctctacatgctcgaaatggcgaagcagtttgaaatgaaccccaaccgccggttattgcaaggtaaggtagtagcaaccctgttctttgaaccttccacccgtacccgtctgagtttcgaaacagcagccaatcgcctcggcgcacgcgtcatcggatttactgatccgaaagcaaccagctcctcaaaaggagaaacactcaaagacacgatcatgatggttagcagctatgcggatatcatcgtcatgcgacactatctcgaaggagctgcccgatatgccagcgaagtagcccctgtgcccatcgtcaatgcaggagacggagccaaccagcacccgtcacaaacgatgctcgacctctactccatctacaaaactcagggaacactggaaaatctgaacatctttctggtgggagacttgaaatacggccgcaccgtccactcactactgatggctatgcgccacttcaatcctacattccacttcatcgcccccgatgaactgaaaatgccggaagaatataagctatactgcaaagagcatcagatcaaatacattgaacataccgaatttaccgaagaaattatcgctgatgccgacatcctgtatatgacccgtgtgcaacgtgaacgcttcaccgacctgatggaatacgaacgagtgaaaaatgtatatatcctgcgcaacaagatgctggaaaacacccgtccgaatctccgcatcctgcacccgctgccccgtgtcaacgagattgcttacgacgtggacaacaacccgaaagcatattatttccaacaggcgcaaaacggtctgtatgcccgtgaagccatcctttgcgacgtgttaggtatcacattagaggacgttaaaaacgatattttattatgagcgaaaataaacaagcattgcaagtagctgccctgaaaaacgggacagtgattgaccatatcccatcagaaaaactctttactgtcgtacaacttctgggcgtggagcaaatgaagtgtaacatcaccatcggcttcaacctcgacagcaaaaagctagggaaaaaaggcattatcaaaatcgccgacaagtttttctgcgacgaagaaatcaaccgcatatcggtagtagcaccttacgtaaaactgaacattatccgcgactatgaagtcgttgaaaagaaagaagtcagaatgccggacgagctgcacggcatcgtaaaatgcgccaatccgaaatgtatcacgaacaatgaacctatgcctacgttatttcatgtgattgacaaggataattgcatcgtgaagtgccattattgcgagaaagaacagaaacgcgaggaaatcaccatcctctagtttctccattcctcattcttaattttttattaaattgaaacaagactggaaaccgggaacgatgatctatccgctgcctgccatattggtgagttgcggaaaagatgaaagtgaatataatattataacagtagcatggacgggtacgatttgtacaaacccgcccatgtgctatatatccgtacgaccggaacgacactcctacgacatcatcaagaagaatatggagttcgtcatcaatctgacaactaaagacatggcgttccctaccgactggtgcggagtacgttcgggacggaattatcgtaaattcgaagagatgaaactcactccgggacgctgcaccgtagtcagcgcaccgctgatcgaagagtctcccctctgcatcgaatgtcgcgtgaaggaaattgtttcgctcggttcgcatgatatgtttatcgccgatgtggtaaacgtccgtgcagacgaccggaacctgaatcccgaaaccggcaagttcgaactggcggaagcgaacccgctggtatatgtgcacggaggatattacgacctgggagaaaaaatagggaaattcggctggagtgtagaaaagaagaaataaagaaaaaagtactgccatgaatatactgcgcaacataattcttttcggttggatggcgatagcttgcacagctttcgcccaagatcgtaacgcagataaagtggaacgtcccaacacaaagaaaatcaactttggtatcaaagccggatttaattcttccatgtttatggtatccgaattgaaaatcaaagacgtaacgatcgacgaagtacaaaataattataagatcggctattttggcgcgatcttcatgcgctttaatataaagaagcatttcattcagccggaagcatcctataatgtcagcaaaggcgagatcacctttgacaaactcggttcgcaacaccctgccatcgaacccgattatgcttcggtacagtccgtacttcacagtatcgacttccctattctctacggatataacgtagtgaaaaaaggaccatacggaatgtctatctttgccggtccaaaactccggtatctatggggaaagcagaacgaaatcactttcacaaacttcgaccagaaagggattcatgaaaagctgtatccgctcaatgtcagcgtcgtgatcggtgtcggcgtcaatatctcccgcatctttttcgacttccgctacgaacaggggataggaaatatctccaaatccatcgtttatgacaatatcaattcagacggcagcacgggagtcagccctatcattttccgccgccgcgacagcgcattaagtttctcgttcggattcattctttaaagaacatccgacagccggctgatgaacttttgatagtcggcaaccggcaaaaacagacacctcctattcattccgtacgataaattatccattatctattaatttcctccatttactaacatttttcttatagttccttcgttctttatttattttcactaactttgtgcgcttaaaataggtatctcgaattaaaaatttaatattacttataaaaagaatgaaaagagacgacttaattttcgacatcatcgaaaaagagcaccaacgtcagctgaaaggtatcgagctgattgcatctgaaaactttgtaagtgaccaggtaatgcaggcaatgggttcttgcctgactaacaagtacgcagaaggttatccgggcaaacgttactacggaggttgtgaagtagttgaccaaagcgaacaaatcgctatcgaccgcctgaaagaaatcttcggtgccgaatgggcaaacgtacaaccgcattcaggagcacaagccaatgcagccgtatttctggctgttttgaatccaggcgacaagtttatgggattaaacctcgcacacggcggacacctttctcacggttcattagtaaacacttccggcattatctacactccttgcgaatacaatctgaatcaggaaaccggccgtgtagactacgaccagatggaagaagttgctttgcgcgaaaagccgaaaatgattatcggcggcggctctgcttattcccgcgaatgggactacaaacgtatgcgtgaaatcgcagataaagtaggcgctatcctgatgatcgacatggctcaccctgcgggtctgatcgctgccggactgttggagaacccggttaaatatgcacacatcgtcacttcgactacacataaaacacttcgcggacctcgtggtggggtcatcatgatgggaaaagatttccctaatccttggggaaagaaaactccgaagggtgaaatcaaaatgatgtctcaattactggattcagctgtattcccaggtgtacagggcggaccgttggaacacgtaatcgctgccaaagccgtagctttcggcgaaatcctgcaaccggaatacaaggaatatgcaaaacaggttcagaagaatgctgccgtactggcacaggccttgatagaccgtggttttacaatcgtttccggtggtacggacaatcactccatgctggttgacctgcgtagcaaataccctgatctgacaggtaaggtagcagaaaaagcattagtttctgctgacattaccgtgaataagaacatggttccgtttgacagccgttctgctttccaaacttccggtatccgtctgggtactcctgccatcacaacccgtggtgcaaaagaagacctgatgatcgaaattgccgaaatgatcgaaacagttctgtctaacgtggaaaatgaagaggtgatcgcacaagtacgtgcacgtgtcaatgagacaatgaagaaatatcctctttttgctgattaagatttctttctttgagtaaccaaatgccggtaatgtgaattagcagcatttgtgttcaacatttcataaagaatttctttagaattttataagcctgctttctgtgaagaaaacaggcttttcttttttatttattaacagaatcagacaaactatctgctcgaaaagatgttttcttactacaaaaagagaaattgaaatacgcactatactcttccggaaagcagcgacttcaatcgtacagtgtatcagacaaggtcaacataccggtacactggactctatatacaatcatccccgtcttcccaaactatcagaagtggaaagacggggatttatattggatgattgacagtacagaaatatactaaatgaaatagtaaaaatcagctcagtccttcaatttcaccatctacaatgtcgatatgcaacgcttgcggttctttgggcaatcccggcatacgaaggatttctcctgcaatcgctacaatcatttcggcaccgttattaatcactatatccttgatatggaactcgaaattattcacggcgccataaatcttcggatcggcagaaaaagagtattgtgtcttggcaatacaaaccggataatgagtgattcccattttctcaatcagcttaatgcggttgcgggcgatgctgctgtacgtaatgacgctggctccataaaggttggtagccactttctcaatcttctgctgtatgctgtcttcttctttatacgtataacgcaaaggttcggacggattattttctatcgtatcgactacgagacgggccatatctaccgctccttcaccaccttcgctgaacgcattattgatggcgtaacctacacccaactgttcgcagtgctcgcgcagcatttccatttcctcgtccgtgtcggtggcaaacttattgaaagcaactactaccgtctgtccgaaagagcgaagattacgaatatgtttatccagattgcgcaatccttctttcagtccttccatgttcggttccttgatgcggtcgaggctgacaccaccgtgcatcttcagtccttgtgccgtagcgacaatcacggtcagtttgggctggagtccgcttttgcggcatttgatgttatagaacttttcagcaccgaggtctgcaccgaatccggcttccgtgatcacatagtcaccgaatgacattgccagtttggtggcaagaatagagttacagccatgagcgatattggcaaacggtccgccgtgtacgaaagcggcggtaccttcggtcgtctgcaccagattcggatggatggcgtctttcagcaataccgtgatagctcccgccactccgagatctttcaccgtaaagggctggtcatcatatgtaaaaccaagcagaatattttcaatgcgacggcgcaagtcttccacatctttggaaaggcagagaatggccataatttccgaagccggagtaatatcgaagcctgactcctgcgtgatgccgttcgacttgggtccgagtccgactacgatgctgcgtaacgaacggtcgttcacgtcgagcacccgacgccagagaatttctttcaatccgaaacctttcgcctgattctgataaagataattatcaagcaaagcagaaatcatgttatgcgcggaagtaatcgcatggaagtctcccgtaaaatgcagattgatcttctccattggaagcacctgtgcatatcccccacccgctgctcctcccttcatgccgaagcaaggaccgagagacggctcgcgcaaagcgacaatcgccttctttccgattttgttcagtcccagggcgagaccgatagatactgtagttttgccgatacccgcctttgtcgctgtgatggcagttaccaggacaaggttacttttcttcactttctcctcgtcgatcagttgttcgggaatcttcgcgatgtagcgaccataattttcgacttcttcacgagggattccgatgctttcggcaacttgcttgatctttttcaactcgacactgcgagctatttctatgtctgatttcatacagaatatgattagttttatttgaagtgacaaaagtataacaaaaaagcgaaactgagaaatttaagacgctctctcgtttgcccggaacttccgcacaattaatttatatttttataaactatgacgataacgcacatactcccctaaactctttttgtacaagaactgttgttaagaacataacctaaacaagaacaacatatatggaatggattattaatcaattaagggatcatcccgaacttgccattttcctcactttattcgccggcttctggctgggcagattcaaaataggaaaattttcgttgggaacagtaaccagcgtgctactggtcggagtactggtgggacaattaaacattagtgtagacggcccgatgaaagctgtctttttcctcctgtttttattcgctgtgggctataaggtaggtccgcaattctttcgcggattgaagaaagacggattgccgcaagtaggatttgccgtcctgatgtgcattgtcagcctcatcgccccatggatacttgccaaaatcatgggctatcatgtaggcgaagctgccggattgttggcaggttcacagaccatctccgcagtgatcggtgtggcaagcgacacgatcaatcaattaagcatcagcgatgcgcaaaaagcgacatttatcaatgctatccccgtagcatacgctgtgacttatattttcggtacggcaggttccgcatggattctggcttcactcggtcccaaaatgctgggcggactggagaaggtgaaagcggactgcaaagagctggaagccaaaatgggaacttccgaagcagatgaacccggattttacaccgccctccgccccgtcgtattccgtgcttataaaatagacaacgaatggttcggcaaaggaaaaacggtcagcgaactggagaactatctggtggaaaacgataaacggctgtttgtagaacgcgtacggcaaaagggcgtcatagaagaagtcaccccggatatgcttctacaaccgggcgatgaagtcgtattaagcggccgccgtgaatatgcaatcggcgaagaagactggatcggtccggaagtgatcgacgcccaactgctcgacttcccggcagagacgcttccggtaatggtcacccaccgcacattcgcaggcgaaaaggtctccacgatccgtgcactgaaattcatgcacggagtcagtatccgcagcatcaagcgggcaggcatcaatgtgccggtactcgctcagacagtgatcgactccggcgatatcctcgaactgaccggaacaaaactcgaagtagaaactgccgccaaacagatgggctatatcgatcgccccaccaaccagacagatatgatctttgtgggactgggtattctgctcggtggtctggtcggcgcacttgccattcacctgggaggtatcccgatcagcctgtccaccagtggaggtgccttgatcgcaggactcgtattcggctggctgcgtagcaaacatcctacctttggcggtatccccgaaccttcgttatgggtattgaataatgtaggactgaatatgtttatcgccgttgtcggcatcgccgcaggtcccagcttcgtgaccggtttcaaggaagtaggattcagcctgtttatcgtcggtgcgctggcaaccgccatcccccttctcagcggactgctgatgggaagatatctgttcaagttccaccctgccctcactctgggatgtacagccggggcacgcaccacaactgccgcactgggagctattcaagacgcactgggaagcgacactcccgcgttaggatacaccgtgacgtatgcagtcggtaatacactactgattatctggggagtagccatcgtattgctcatgtaaatgtcagtatagtgaatgtataggaaatcaaaattaagtatcaaaataataaaaaccattatggaaaagaaaacaactggcacagctatcaccaagaactttgccaaaaagatggaaacgatcagccctttcgaacttaaaaacaagctcatcgaaatggctgacgagagtatcaagaaaatggcccataccatgctgaacgcaggacgaggcaacccgaactggattgcgaccgaaccgcgtgaagcattcttcctgttaggaaaattcggactttgcgaatgtcgccgtgtccaatccctggaagaaggaatagcaggcatcccacaacaggaaggaatagccgcccgcttcgaggctttcctcaaagagaacgagaaagaagccggagccaggttactgaaagaaacctataattatatgctgatggagcacgcagccgatccggacagactggtgcatgaatgggcagaatcggtcatcggcgaccagtatcctgtccccgaccgtatcctgcacttcaccgaactgatcgtacaggattatctggcacaggaaatgtgcgaccgccgtccgcccaaaggcactttcgaccttttcgctaccgaaggcggaacggctgccatgtgctatgtattcgattcattgcaggaaaacttcctgttgaatcaaggggattccatcgccctgatgattcctgtcttcacgccttacatcgagattccggaattacgccgctatcagttcgatgttaccgaaatatctgccgatcagatgacaccggacgggctgcacacctggcaatataaagatgaagatatcgataaactgaaaaatccgcagataaaagcgttgttcatcaccaatccgagcaatccgcccagttacgcgctgagcccggagactgccgcacgtattgtcaacatcgtaaagaatgacaatccgaatctgatgatcattacggacgatgtgtacggaacattcatacctcacttccgttcgttgatggcggagttgccgcataatacactctgcgtctattccttctccaagtatttcggagccacaggatggagaaatgcagtgatagccctacacgaagacaacatctacgacaaaatgattgcccgcctgtcggaggagcaaacagcaatcttaaacaagcgttatgcaagcctcagtttacatcctgagaagatgaagtttattgaccgcatggtggccgacagccgacagattgcactgaaccataccgcaggactctcgctgccccagcaaatgcagatgagcctgttcgccgccttctcccttctcgacaaggaagaccggtacaaggcaaagatgcaggaaatcatccaccgtcgcctgcatgcactctgggacaacaccggctttacgctgatagaagatcctctacgtgccgggtactattcggaaatcgacatgctggtatgggcgaagaaattctacggtgacgaatttgtagactatctgcaaaagacctacaatccgctcgacgttgttttccgccttgccaacgagacttcgctcgtcctgctgaacggcggcggatttgccggaccgaaatggagtgtccgtgtttcgctcgccaatctgaacgaagccgattacgtaaaaataggacaaagtatcaagcgcgtactggatgagtatgcaaaaaatagataatacttattatttaaagcgggaagtatccacctcttcccgctttttctccttgtatcctccaaatttgtagttgaaggaaataccgaaggcacgggtagtcttcatatagtgattcttcacattctgttgtccgaaacggacattagtcgaaatggtggaagtattaaatatgtcatcacatttcaaggttagttgtgcttttccctttgcgaaagtatagcgcagggccgcatccagatttcccgaacggggaaggtcgaaaatgccttgtatcgccttgttctgataaaatccgcttagggtaaacttcaaatcaggtttggtggaaagagtgaaggtattgttcatggtcaatacaaacgtatatagtttgcggtcgaacgggatatcccagaaatcactgtctttctgacggtaacggaagccgattgccgtgatgcgggagtccagccatttcttcactttaaagggaactaccattaccaagcccgcctgttccgagaagtcgaagttaaagcatttatagatctcgaccagacgttccggagactggtaaagcgtctgcatttccttgtttttcgtgcggctgtaataggcggtcagcacatatttaccttttaatatatagctaatgttagcttcgtagttggttgccggtttgaggaagggatttccctgaatctcggaataagcgcccatgtaggaagtggagttctgcatactccagtattccggatattccttgtcgctgctcaatgaaaattgcaggatatgtcccggggcaggcaaataagtcaggttggcaaccggatacaggctccattcgttccacatatccgtatgatattgctcggcagccagagagacatccgccgaaagtttctcaccgaaactcttgctgagtccggcataaaagttcagcgtctgctcgcgacgacgggattgcatgttgttgtccggcagtaaagtttccgtttcgggatcgaaatacatttgataactattgtccaatgcggtcgtataagcaacaccataattcaatccccagtctgcgcccaaagtatgttcttgtccggcatagaaacgccattggttgatccgttggttatctttgctcaggaagttcagtgtttcttctcccagtgtgctgtaaagcagctgactgccgggagcatgataataggtaaattccgctccggctttcagtccgaaaggagtctgatagtcgagtttggcattatggagctgtccttccgagtgcgaatcggtgaccgagttctgcgcaccggtgactgtggcgtaaggtttgacatcggtgaaagcagtggtataaaccaagctcagcaaatgcttgtcggtaaaggcatagtccatcccaaggcgtatctggtgattgttgtggcgggaagtagtgatatcatacatattcatcggatgcaccgaaccgtcggcgagcgtgtgaagcgcttccttgtctgtctccctccgttcgcggctgtaagagtaagagtagagaagatcagcagaaaatttgcgtccggagtatagaaggctcgcacgctctgccagagattcgtagtgtaattggctgtaagcggtatatagttctccctgaagagaaggttcttttcccatgcccgaagtcagtatcagattgatcatcggtccgcgcacctgataacgtgccggagcggaatacatcacttccgccttttcaatccgactgacgggcattgatttcagcaggttgcttaattgctctacagagagggtggtcacttttccgttgataaccacagtgaccggctgccctcccaacgtcagggcatcattcatggagacaactcccggcaggttctttactgcatcataggcattgtctaccggcaggctgccgaccagtctcggaacgtcgtataccagtttcccctgttcggcttttactaccggacgttcgccggtgatcatgacttcgggaagttcccgatacaggctgtctatataggctacgttttttacgctgtcggcaggttcctgcgctgtctgtacctgctgtgcagaagcgtacatccaatacatgaaaagtaacaaaagcagtaaataagttcgtttcatatcgtatttatttttgagtatgctgcaaaatacgggagaaaaaacgaaactttacgttatcgccggcttatctagtgttatttagtcttatcaaagagaagaaagataatagtttcatactatctttgtccgtatgaaattaccgttgaaacatatcatcatccttgtcatctgctcgctgacaggcatctttgtttaccagacatattggctgacagggctttaccgcacgatgaagcaggaaatgaacaataatatcaaagacgccatgcgtacgagcgactttaatgaaatcgtgcttcgcgtcaacgagctgcaaaaggataatgtggaacatggttcggtcaccgtttccgccggatatggtgcagacggcaagtcgctggtgacaagccagaccgtctcttatacggacagtacctacaaagacaccctgcatacacgcacggaaacagcagtagataccctagccgtcaatgccaacgatccggatgccagcgccgttgcctccagcgaaagcggacttgatgtattattaaagaaacaggactcgatgaaagaactcatactcagcgtccaacagggtatgcactccggcgtggatacctacatcgacatcaacctgcaaaaatatgacagtctactgaccgatgtactgaaagcacacaacatagatgtgcctcaccgtaccttatatatatacagcggagctactcaggattcatcccagacattcatagatacactgggcatcgcaggagacagcacctatatccccagcccgaaagccatccgctacaactacgaattcaacaggcatcacagtcaacgctaccaactgataatggaacccatcacctccctggtatggaaacaaatgactggcatcctggtcacttcatttgtcatcttcctcatcctcggattttccttctggttcctcatccggacactgctgaaacaaaagacgctggaagaaatgaagagcaactttacgaacaacatcacgcatgagttaaagactccgattgccgtggcgtatgccgccaacgatgcgctgctgaatttcaaccaggcggaagagaaaagcaaacgtgaccaatatctgcgcatcagccaagagcagctacagcgtttgagcggactcgtcgaacagattctttccatgagcatggaaagccgcaagacgttcagactgcaccccgaagagatttgtctaaaagaactgattacttctttaatagagcagcaccagctaaaagcggatatccccgtacacataacactggaaacagaaccggaagcactgacgatagtagccgaccgcactcatttcagcaatatcatcagtaacctgatagacaatgccgtgaaatattcgaaacaagaagcagagattatgattcagtgccgccaaacgggagaaacggtgactatcaccgtctctgatcatggaataggtatccctctggataaacagaaacatatattcgacaaattctatcgcgttccgaccggaaatcttcataacgtgaagggatacggcttagggcttttctatgtcaaaagcatggtcgaaaaacatggaggcaccatcaccgtcaaaagtgaatccggcaaaggaagtacatttaccattactatctaaaacatcagaaccatgagcaaaaacgacattacagtattgttggtggaagacgaactgacactcgccatgattatcaaagatacgctcgaggaaaacggttttaccatacataccgcctccgacggcgaagaaggattgcatcttttctttgaacttcggccggacgtgctggtggccgatgtgatgatgcccaaaatggacggattcgaaatggtacgccgcatccggcagacggacaagcagacacctgtactgtttctgactgcccgttcggccatcaacgatgtggtagaaggattcgaacttggggcaaacgattatctgaaaaagcctttcggcatgcaggaactgatcatacgtatcaaggcgctgatgggaaaagcgttcagcttcacgaagacaaaggtatccagccgttttgagataggaagttatctgttcgatccggtcgcgcagacattgctgcatgccggagtgagacaggaactctcccaccgcgagtcggaaatactgaaacggctttgtgaaaaccggaatcaggtggtcaatacgcaggacgttctgctggaactttggggggatgacagtttcttcaattcccggagtctgcatgtattcatcacgaaactgcggcataagttgtcgcaggatgagcaaatacgtatcgtcaatgtgcggggaatcggctataaactcattgcaaactaagctctaaaatagtgtcactatcctactggcatagtgtcactatccccacaggatacttacactatcttagtgggatagtgacaccatcccgacgagacagcagcacactcctttttaaaggatttttctctaagaaaacataacggaagcaggcagtcagactaaaaatctctatctttgtcatcaatcaacctttacgaagatgagaaaactgattctatttctttcgctgatattatcggtcggttttgcatccgcacagtcggaggttccttccgatagtattcgtcgtgctccgtcgagcaatataaaggaattcggtggcttcctgctcgatatgggattaatgaatgtggcccctcccaaacttccgaaattcagtctcgatgtaccggatgtgagtaaagactataatcagatattccgtctgaatacagacgccagctatacacagggattcaccgacgcattttcttcccctttctccggtttcggatatgggtatggctggggattgtcgtcttcaccgcagttcatgcagatgggcaccttcaaactgaaaaacggatggaaaatcaatacatacggagactatgacaaagacggatggaaagtgcccaaccgtagtgccatgccttgggagaagaataatttccggggagcattcgaactgaagtcctccaatggtaatttcggtatccggatcgaggttcagcagggacggaacggtctttattaactacgctactcattatgatcgacttgtttcggctattagcatatcctgattagctattagcataatccgattagctaatagctaatcaggatatgctaataggatatttcaatcatcaataacaagatgagttatttactcaactaacgtttattctgcttcaaaagctctgtctgccgcagccatcgcgtcggctacacggtcgcaccatgaatcgaactccggatcaggagtctgtgtttcggggtgcgaaagcatatattgcactgactgtcttaaaccgtccgccatcgaagttgtacagataaagtccggcacaaggcgttttattttcgaattatcaaagactaccgttgcggctttatcccccaacagttcgccccgaaagtcatagttcccgccatgtctcgcaagaaaatcggaagccacatggagtgcgttcagaggtttccccagcgcatcggcaatggtttgataaatctgattccaagtcatactctcatctgtggtgatatggaaggcattcccgatggcatgagggttcgccatcagtcctacatatcctttggcaaaatctttggaatgtgtcagtgtccacaaggaacttccgtcaccagggataataaccggtttcccgtcaaggatacgtttaagtatctgccagttccccttatttccatgcaggcttacaggaggtttcgttccattatacgtatggctgggacggacaatcgtaatcgggaaaccggtggtacggtatgctgtcatcaacacttcttcggcggcaatcttatgccgtgaatattgccagtaaggattcactaaaggggtactttccgtaatacggtaatcagccaacggtttttggtaggcggatgcactgctgataaaaatatattgtttcgtcttattacggaacagacggatatcacgttctacatcttctgccgtgtaagcgatgaactgagctacgacatcataactttcatctgcaatagctttcgccacagcttcctcatcgtgaatgtcggcaatgatactgcccacaccttccggcagtttttttgagccccggttgagcagtgttatctcccaccctctctgttgagccaattctactacatcggtactgatcgtaccggttcctccaatgaataatgctttcataaaacaagtctttttaaattcacaggaacaaatatattaattctactattcacatcccttgattatcccgtttttttgtttccgacacgctgatatttagctgaaaaaagtgagtttgcatcccactacccaccggcattgtatacaaattactgaatcttatacccaaattactgttttgcaaatacggaatgagaaagatacatttaaaagctttatctttgtgacagatcaaaactgtaagccgtatggaagaaataacaaaaattgaaagcattgaccagtatgaccaactgttcggactagagaccttgcacccactggtaaacgtgatcgacttctcgaaagcgacaaagacggtagactactatcgtatgaatatcggattctactctctgtttctgaaagacgcaaaatgtggcgatctcagatatggacggaagtattatgactatcaggaaggaaccgttgtctgcatggctccgggacaggttatcgggatagataaccgcaagcagacaccaattcgtacaaaatctatcggccttttatttcatcccgatttaatccggggaacttctttagggcagaacatcaaacactatagtttcttctcttacgaagtgaatgaagcactgcatctctccgaacaggaaagggaaatcgtgaccgactgtatccacaaaatacaaatcgaactggaacatgccatcgacaaacacagcaagcagctcattgtccgcaatatagaactattgctcgactattgcatgcgcttctacgaacggcaattcatcacccgtaatcaggcgaataaagatatcatcgtgaagttcgaacagttattggacgagtattttcagaatcagactgcacttaccgaaggacttccttctgtaaaataccttgcggacaaagtctgcctttcttccaattacttcggagacctgatcaagaaagaaacaggaaaaacggcacaggaatatatccagcaccggatcatagaacttgccaaggaacggatattagaaggtagccagacggtcagccagattgcgtatgaactggggttccagtatccgcagcatttcagccgattgttcaagaagaatgtcggatgtacgccaaacgaatataagcaacagaactaaaacagctccattaatcaggatattagttacgtcatgggagataaagtacttaagataggaagtgtgcatcaatgtaattgctgcatggggagtaagacactgcaccctctggtcagtgtcatcgacctttcaaaagccgatttatcctcccatacggatttcaaattcggattttacacgattctgttgagcgaatgcaaatgtgaagcctacagatacggacatcagtactacgacttctcggacgggacacttctctgtctgactcccggcgagtcaatcagtatgaaggatagtgacaacacatgtccttccaaaggatggatactggcgtttcatcccgacttgatctgcggcactgtgcttggagcgaacattcgtgactatactttcttctcttatcgtcccgaagaagcactgcatgtttcattacgtgaaaagcaggtcatactagaacttctggataaaataaatgaagaattgcaacgctgtatcgactgctatagtcagaagatcatttccaaatacatcgaactactgcttgattattgcgaacgcttctacgaacgccagttcatcacacgcaatgaggctaacaaaaagattatcgaacggtttgaccgtcttttggatgatcatttcaatactatacaaagtcagtcctccgatcttcccactattgaggagtgcgtcagagtacttcgtctttctcccgcatatttcaatgatttgctggaatatgaaacggggaaatcgtacaaagaatatcttcagttcaagcgtttcgagatagctaaagagtggttgataaatacagataaaacactcagccagatagcgcaggaactcggtttccggaatccgcaatatttcagccgcctgtttaagaagatcaccggttgtttgccgaatgatttcaagatgcctaactgacttttctcttaataaaaatagaattaagaattcaaattcttaatcaatgttataaaacatactatttttcttggataatttgcaaagttcacagaagtccgtatctttgcaatgtgtttttcatagtattagatttaaggttaacaaaggttggagcaaggcgttgctcctttttttatgtccatacgtgagctattggactttcgtatatagtagaattacattatttttcagtagatttgcagtaacacttgaaaaggatacattcagattatattctgaatatataaatcaaaaagtgctctttttacgttatatatcaagaagtaactttaatcctgacaaaacaatgaagacagagcggaaatatcaccatttgattaaatcagttatcatcgtactattcctttcttttggcatgacttcgtgcgaaaaggaagagccagttccggtacctacagaacaaacggtattcatgtatctcccctggtctgataatctcacatccaatttctatcagaacatcagcgaccttgaaagtgtagttgaaaagaatatcttgaaggatgaacggataatcattttcatgtgtaccacagcaacgaaagccactctttttgaactcgcttatgagaatggcaagagtgtgcataaaactctaaagaactatacagatcctgcatataccacagcagaaggtatcacatccatcctaaatgatgtgcaacgctactctcccaccaaacgctattcgatggttatcggctgtcatggcatgggatggatacccgtatcaaattctaaatcacgtagcggtcttcgtaccaaaatgcactgggaatacgaaaatgtaccaatgacacgctacttcggaggattaaatgcccaatatcagactgatataaccacacttgccaaaggaatatccaatgccggacttaaaatggaatatatactctttgacgactgctatatgtcaagcattgaagtagcctacgctctcaaagatgtgactgattatctgataggatctacaagtgaagtgatggcgtatggtatgccatacgccgagataggtcagtatctaattgggaaagtagattatgccggtatctgtgacggtttttactctttttattccacttatagcacaccctgcggaacaatcgctatcactgattgctcagaacttgataacctggcaactattatgaaagaaattaatcatcgatatacttttgatccttcactaaccagttctttacagagactggacggatattatccggttatcttctttgactatggtgactatgtttcaaaattatgccctgatgaaactctagtggcacgattcaacgaacagctcaatcgtacggtgccattcaaaagaaatacagaatatttctattcgatgagcagaggagaagtgaaaatcaataccttctccggtattacaatctccgatccaagtacgcactcgctggcctcaaaaaaagaagaaacagcatggtatgcagctactcactaggaacaagagataagatcaggaaatctcttaataaaaatagaatcgagaattcaaattcttaatcaatgttataaaacatactatttttcttggataatttgcaaagttcgcagaagtccgtatctttgcaatgtgtttttcatagtattagatttaaggttaacaaaggttggagcaaggcgttgctcctttttttatgtccatacctcatctcgtcagctaattttatcctttgatcaccgccataggcgccaattccaccaaaggtttcactaaatcccgctcattagcaattacctgcgcaatatctttgtaagctcccggtacttcatccaatccatccggcatgcgcatcggacctgataatgatatgcttaaattcgcaaaagagcaaaagaaaaagggaactacgaaatctatttgcgtaactaaaattattttctacttttgtgaaaataaatatagaaaagccatttctgaaccgaaactcactcatgtgactgagaaaaactcatatgactgaaacgaacgactataaaacagcccatgaagaatataataattatcggtgccaatggattcaccggacgccaaatactgaatgacctgtcgagcaaggcacaatataaggtaacaggatgttccctgcatccggatatccttccgaagaatggaggcaactatcatttcatcaccacagatatacgggatgaagcagtcgtaaagcaactttttaaagacgtacaacccgatgtagtcatcaactgttccgccttatccgtccccgattattgcgaaacgcatcacgaagaagcctggctaacaaatgttacggcagtagaacaattggcacatctttgcgaaagttacaaaagccggttcattcatttatctacagacttcgtctttgacggaaagatagacgagaagtccggacagctttatacagaaaaaagtctccctgctcccgtcaactattacggtttcaccaaatggaaaggagaagagaaagtgactgaaatctgtagtaactatgctattgcccgcgtagagattgtctacggaaaagcattgccgggacaacatggaaacatcgtgcaactggtgatgaatcgtttgaatgcaggacaagaaatccgtgtcgtatcagatcaatggcgcacgcccacctatgtaggtgacgtatcagccggagtacaacacctggtagaaaatgccgcaaacggaatttttcatatctgtggcgaggaatgcctgaccatcgcagaaattgcttttcaggtagcagactacatgaagctggaccgttcgctcgttcaccctgccacaacagaagaaatgcaagaagctactccccgtccccgtttcagtgggatgagtatagcaaaagcccggactatacttggttaccagccacgaaagctgaaagacatcctcatggagtggaaacattaaccgacaaatcctattaatcagattgtttgcacaaataaaagtatgtgctctacacaacatagaaatttgactcaggcatcgaactggcaactaaataaaaatgatataaacacataatatataaaggttaaggtctacataaccaagtttttactacattctattcctagtttcagctacctttcccatcctaattattgcatatttattttgaaaatatgcaataagttcttatctttgcacccgaattaaagaaccagaagatgaatcaaacattacaattacataacgcccttatatttcatgcggaaattcccaatttctgcacgtcatgttgcgtgcatgtacattggttcagcggattcatctaaattccccttactcattcttacccctaactgcctgttgacttatttcgttactcacagacagtatttccatctgattgtcaataagatgtatgtctttttggggattatctatgctatttatgaattgtttaacctaaccaactaaaatatattacaatatgttctctattatatctaccatgtttttgggaatcggtatcggatacggattacgtaactggagtatcttacaaaagactgaaaagacaatttctcttacaatattcctgttactctttatccttggagtatccattggctctaatagcctgattgtgaataatctcggtaagtttggatggcaggcgatcattcttgccgtatccggcgtattagggagcttgttggctgcccggcttgtgttacaactatttttcaagaaaggaggtaaacaatgaaaggaagtctcatcgttatcgtatttttctgtgtaggctgtatcatgggagtttttaataaattccagttcgacacacatactgtttccatgtatatactatatgcgttgatgctgcaagtaggaatcagcatcggttccaataagaacctgaaagcgatcatctcacatttgcacccgaaaatgctgctgattccattgggtaccattaccggcacattgttgttttctgccttggcaagcattttgctaagtcaatggagtgtattcgactgtatggcagtaggaagcggattcgcctattattcgctgtcttccatcctgatcactcagttcaaggaaccgaccatcggaatacagttggctacagagctgggtaccattgccctgctgactaatatctttcgcgaaatgatggcacttttgggtacaccgcttatcaagaagtatttcgggaaacttgctcccatttcagcggcaggagtcaactcaatggatgtattattaccttccatcagcagatattcgggaaaagaaatgattcctatcgctattttgcatggtattctgatcgatatcagcgtgcctgtattcgtttctttcttctgtaacttataactctgtaccccatcataccataatgtccgaaaagcatatctgacctatcattctgtcagtagcttttcggacattatttttttattaaaatgagttttttaatgccccgccgtcgccaatacaaagcgaatatcagcgtaagaaacttcatctcccaatgcagctttaatagccaccactcccataaactcatgggtttccagataagtccggaccttcttaatcttgtccgctgtcactacctgttccaattttattttatcttcgcggagataatgttccagatgagcagcaatcgttcctgtcaccaaatcacgggttttggctatctcctctatagtcatcccttggcagaacatttcataactcaccagctttgaatctttcttcttctctttctgcttcttcttatcctcatgatgctgcgcgtccagcttttgttcacgtacatcctctccgcccgaaacagaagtaaagatctccggtcgttccagtttgttctccttcatatatttgcgcacaatgcccaaaatttcaagtccgtacttctccactcctttcgcaccgaaataaggtatcgcttccaaagctactggtgtatccggcaacagattcacaatacccatcaatgccttttgctgcatgatcacataagccggcatattcacttcgcgcgtctttgccgttctccattccgacagagcacgataaagttccggatgcagaatatccgtcggaacttctattttcacctttcctgaattgctgcgagtgcgttctttccgttcttttttctccttcggagccttggtggaagaaccggaagaagcagtttcgccttcgagactcaacatcactttcgctttccgtttcagataatccgttaccgtaaatttctccgtccgcatcgcatccaacaaagactctttaatccataaagcatcatccaatgcctgcaaacgttcattcagttgtttccgcaactctttattatcaagaggcatactggtcttgtcaaacagcacccgaacaggaagcaatgcttcacagaaataagcagcaccggaatgaatcctttgctgtagctcctcatttccggcataattttcattctcgttaatcagacgcgtatattgattacgaaagcgattggaaacttccaccaccttctctttgagatgcggagccagttctttatactcggcaagcaacttcggataaagtttataaagctcttcatccatcatccggagcaaccgcttataagcctgctcaagcgaatagaaattaaataaatcattcaacagatcatagaaataagccttttgcatgtcgttcaactgcttgctccccggtttattctgttccacatctcttgtgaaattatctacaatgctatcgctgattatcgcctccctacgcaaaggagtctccaacaccattccttccagagtcttgcaacggctcaatgctacatacgtctgcccatgagcaaaagagttacgagcatcgataatcgcccgctcaaacgtcagaccctgactcttatgaatcgtgatagcccacgccagacggatgggatattgccggaacacaccttctatttcttccgtgatctccttcgtttcttcgttcagcacatacttataattcccccattcttcgggcaacaactgaaagacatcactactgtcttttccacgtacggacattcctttttcgtcaacactcatcacttcgcctatcatgccgttatagtaacgtttttctgatgaaacgtcattcttaaggaacatgatctgtgctccttctttgactgtaagcacttcatccgcagggtacgagtactcaggaaaatttccctctatctccgcccgaaaactataagcccgtccagacagtgatgccagttcacggtcgttcacctgctgggcctgatagttatgcgttgtcagtcggatatacccttcttctttccgtggacgaaaaccgggctgataacgacgattcaattcgttcaacacttcatcatctgctttattttcgcgtatcttgttcagaagagaaagaaagaaagtatcactctgacggtagactttctttagttcaatggtcatatacaccgtttccttcagtgcacggctggcaaaaaaatatggagtctcgtaatgattcttcagtagctcccattcattgtcttttaccacaggagccaactgctgcaagtcgccgatcatcagcaactgcacacctccgaaaggtttttcacggtcacgataacgacgtaaagccgcgtccacagcgtccagcaaatctgcacgtaccatactgatttcgtcgataacaagcagatccatgctgcggataatattccgtttctctttgctgaaacggtagtgcatcttggcagaattgaaagtcgtttccggcacaaacggagcaaaagacaactgaaagaatgaatgaatcgtcacccctccggcgttgatagctgcgattcctgttggagccaatacgaccatgcgcttgggggtatgttctctcaatcgttttagaaatgtagtttttccggttccggcttttccggtaagaaacagatgcgtgcctgtattttcaatgaactgccaagctagttgtagttcaggattattttccatgtttcctctaattttcggtaaaggtactgaatagattccaaccaccgaaattgaatgtaaggaaaagcaataatcaagccggtattttcatcatcatttctttactcccgaaatatttgtatacaaataaacaaaaaaggtcccggtttcttctcgcttgaagtacaccgggaccggatcaaatcagaacacaaagtcgtgtcacagttatatatcgaaattgtttttgtttcttaattcttgggagactgatatctcttgtaccaatctgtagattttgatccccaagaatcagcccaattcttgaaataaggatattccgtatcaatgttatgcgtctccgtcaccggaatgaaattcaacatcggaatatcgatggcaaacggataagctccgtcacgatcaatgtaatagacatccttactagaacctatcagcgatttgtcagcataagatgtcggtgaatatttaggcagatgtacttccgtccggttctgttgccctgccgcatattttactataatgtacggattatatatcttcagattctccttattaaaagtggccttttcaaaggttctggttatcgtacatgtacccactttccccttaacagcttgttttacacttgggaatacaataatagaagacgtttcgctctccacttttatatccttatctgaagtcactttaccaaactgtcctccatctatctgataagcaaatgcattatcatacatcgctccgtcgtgtgtgggcgtaaatgtatccacaatcttatttatcatgttttctgtgttgaaatatatggcacgattatattctacgatcacgtcgttcatgtcataatctcccccgtcaggccaaatatcttcaaaagctaaagtcccctttaagttctcctgtgcatccggcttttctattggtttatcatcactcgggatattgggtctgttcggattatcaatagaactttccggagaagcatctacataaaatagtagatcacaaaaacttctgtttgctccatcttccacaccaataatggtttttccactcttttcatcttttacagatacgaaaccaccattagaatacccattagaagttattaatggctttgtaatgtcaatttcattctcattttgatgatacccatctgcatatataaaccatcctactgtatatcctttcggaaatttctcacttggtttaccatcctcaccccaaaagagcagacgtaccttatctccacacttcaaaatagataaagctccattatatacggaaaaagcaacatttggaaatacgatatacttcctcatattagagttactaactccatcacttgttttataataataatatccaaatgaattattaaatgaagcgtccctgtcaagaaagaccaaatctaacgtagttccctcttgtgttacattaatattagtgatttcagatcccttatacaaataagcgttgtcaacagaacctccggatggcttgaaaaaagagtttaaacgttctacaagatttccaatcaattcattacccacttgtttttgaggtgttacatatccattattaatagggtctggctttcctgtttgactattataaatataggtgagatttcctccttctccccacttacacaatgaatacaaattagcaccggaattgataagatacggcacgttacctttcgaaaagtcataagaacgcgttaccgctttagtattggcagtagaagaatcctttttactcatatcaaaactagccatcccatctttgatatctagttttacgcatcggggcactccccagcttgatgtatacaagtaaacagtctctacagaagtcggaatattcattttcccttcatattttccatttccatccgtgaaaattttgaataaagcttcaaccccttctttctttaccggaacattgtccactacttccatcgggtcttcatcatacacttcaagtagagccacaagtccggggacatcatagtttactgagagtttcacgtcgccacgtgtttcaaatccgaaatactcgctagggtccggaagaggttcttttccataattaggatcgtacagatctttttccatacatccagccaacagcccaccaatcaatgctgccgtagcaatagcaccagaaatgccgaataatcgcttttgtgtcataatctatatatttgttttgttagttatcaaggcttgttttgttcccatcaaaacaatctcacctctcaaataattttcaaatatatagattatttaattaccagccggacaaagcttaaaaacggaataccgattcacaaaatagtgttatcgtgcaatctttatttactgcatagagccacccacgatatccaataattcgttggtaatagcctgctggcgactcttattatattgcttcgtcaaatcctggatcaattcgttcgcattgtccgtagccacctgcatcgccaatgtgcgtgccgcatgttccgaagcgttcgaatccacggcagccgtaaaaagcttctggctcaataccgttgggatcagattggcgatcagttcctctgcagaaggttcgataatgtaatcattcgctatttcacctccttgtacttcttcttccttttgcttctcttcctcatccacgacccgtgtcaggtcaataggcagataagtttcgcgaagcagaatctgcacgcccattgatttaaaatgatgatagatcagttctacccggtctatttctccggatacgtacatttccattaggcgatgtgccagttcggaagcctcctgatacgatggtttgtcggaaagcgtcggtgaagtctcctgcggttcgaatcccaggcgtttcactgcttcatccaccttcttccctaccgggaatatcaggatattatcctgtcccagtgtacggaactcgccgaccgtttgcagcagcatcttaatcacatttgcattaaaagcaccacagagcgacgtattcgaagaaaaggcaacgattgccacacgcttcacttccctcgccttgatgtaaggagattcaacaggaaggtcggcactcaggaaattggtcagaatcttgttaagcttcctttcgtaaggcagcatattttcaatggctccttgtgccttgtgtaacttggcagaagccaccatcttcattgctgaagtgatttttcgggtactctttaccgaatttattctggtttttacttctttcagtgaagccataactatttaaattaagaattaagaatgagtgtgtgtcaaaagtcagtcccagttcagttactattgacttttgacacagcgtcttcattttataaatattgtttggcaaccatagcggcagtctcttcgatagccttggtcacgttatcgtctatcacaccggttctcagaacgtccagcacatcttcctgatgattgagttgtaaagattcgatgaagctgcgttcaaaatcctgtacgttttccaagggaacatcgtggagcagaccgtgcgtgccgcaatacagaatagcaatctgttgttctaccggcatcggactatactgaggctgaatcagcaattgtgcattcttacgtcccttgtcgatagtcatcgccgtaatggggtccatatcactgctaaacttggagaaggcttccagttcacgatactgtgcctggtccatcttcaaggttccggccactttcttcatcgccttaatctgagcgttaccacctacacgggatacagaaataccgacattgatagccggacggacaccttgattaaacaagtccgtttcgaggaatatctgtccgtcggtaatagaaatcacgttcgtcgggatatatgccgaaacgtctcctgcctgcgtctcaatgataggcagagccgtgagtgaaccaccacctttcacgatacctttcaggctctccggaaggtcgttcatttcgcgtgccacttcttcttccttgatgatctttgccgcacgttccaacagacgtgagtgcaggtagaagatatcacccggatacgcctcacgtccggacggacgacgaagaatcaacgatacttcccgataagcaactgcctgcttggaaaggtcatcataaaccaccagcgcatgacggccggtatcacggaaatattcaccgatggcagctcctgcaaacggtgcataatactgcaacgctgccggatcacctgccgtagcggcaacgacaatcgtgtaatccatcgctccatactcacggagcgtatttacgatagaagccacggtagaacctttctgaccgatagctacataaatacagtacaccgggtcacctgccagaaagttattgcgctgattgataatcgtatcaatcgcaatggaagtttttcctgtctgacggtcgccgataatcagctcacgctgtccgcgtccgataggaatcatagcgtctacagctttcaagcccgtctgtaacggttggtttaccggctgacggtagataactcccggcgctttgcgttccaacggcatttcatacagttctccgccgatcagcccttttccgtcgagcggttcgcccagcgggtcgatgacacgtcccagcatgctttcacctacacggattgaggcgatacgcttggtacgtttcactataaagccttccttgattctgtcggtaggtcccagcagaacggcacctacgttgtcctcttcgaggttcatcacaatggctttgatgccgttgtcaaactccagcaattcgttggcttcggcgttccgcaatccgtagatacgtaccactccgtcgcttacctggagcaccgtaccgatctcgtcgagctgcacgttggtattgataccttcgagctgcttgcgcaatatatcggatacttcgcttactcttatattttcagacattatacaattctcctattcttatcaataaactgttgtttcactcgtttcaactgcgtggcaatgcttgcatcgagccgataatcattgatatcgaagatgaagcccccctctatcgagggatcgatcacagtatccagttccatttgggcatgcagaatatgtgctgctgcggaacggatccggttttctgtctccttgtccaccgggactgccgtaatcagtttgcctactccgatgtgtttcagtttccggtaaagatcgagatacatcaggctgatgaactgcaaatagccttcgcgcctgtttcgcagaaccagcgtgatgaaacggacaaactctctgctggattcaccgttaccatcggcagccgtacatatcagcgccaacttgtcctttaccgacaccacaggattatcaagcacttcgcgcagtcccggctggacacgaaaactgtgagacaatgtgaagaattcgttgtagagtctatcctccacacctttctcctgagcgtattcgatcatcgctttggcatatcgcattgagagtactccgacttccatcttccttagttcttattaggggttaatacttcatccagcatacggtcgatcattcccatctgggattctttgtcctgaaggttcttgcggagcaccttctcggcgatatcgacagaaagcacagctacctgtcgacggatgtcgcggatcgcttcatccttctctatctggatttgttgtttcaccgcatccagttctttctgtgcggctatctctgcttgcttacgggcctcgtgaacaatcttgtcacgttcttccattgcctccttcaagattcgtccttgttccttgttggcagcagccacaagcgcctcgccctcttccttcaaatgagctaactgggcgttggcttcccttgccacctccaaggactggtcgatataggttttacggccttccaccatcttgatgatgatggggaaaccgtatttcgctaatatcacgaacacaaccccgaatgcgacaaacatccagaacaacaggccactatcaggtaatagtaatgacatatctatttaatattacaggaagaataccagcagacatactactaccgccaacagagccacaccttcgatcaaggcggcggcgataatcatattcatacggatgtcacccgaggcttccggctggcgtgcaatagcttccatagccgaaccaccaatcttaccaatacccaaaccagctccgattactgcaagacctgcaccgatagctgcacctaatttacttactcctactgctgctgcagtggcttgtaacaatactgatagtaacataattttcagttttaaaatggtttattttctcgtttatttatttgctctctcttcgcgtttattctgcttttacttttgcaccttcctgcgccagtccgataaatacggccgaaagcatggtgaatacatatgcctggatgaaagctaccaacagttcaagcgcattcataaaaatgttgaacagtacggaagctaccgtcagtgtaccgttgagcgcaggtcccatgcttgccgagataaagatcaggcaagtcagtaccagcatcgccatgtgtcccgccagcatattggcgaaaagacggatcatcaaggcaaacggtttcgtaaagattccgaagaactcgatgaaaggcatcatcggtacaggcactttcagccaccagggcacatccggccaaaagatatctttccagtaatgtttcgttccaaagatgttgactgcaaggaacgtacagattgcaagcaccatagtgatggcaatgtttcccgtcacattcgcaccaccggggaagaacggaatcagccccatgatgttattaatgaaaatgaagaaaaacgcagtcagcagatacggtgcaaacttccggtagttgggtccgacacaactcttgatgatatcatcgttcaccatcatgataaacatttccatgaatccgataaaaccacccggtgccaatgctccctgcggacgcttcctgtaccattgcgccacactcagcacgataaccagcagcagcacactgttgaacaacaaagcgaatgtcaccttcgtaatggaaatatcccacggacgaacctgctctccggctgcattatactccaccagtttgccttcgtacttacttccttcgggggcgacggagagcccttcataagtgcctccattctcagcgagacgggaagaaaggaacgtatgccaacctgtagtagaactataaacaatgataggtaatggtatagtaatgtgcgttttaccccacgtcgtaatatgccattcgtatgagtcgccgatatgcccgaacacgatctccttcacatcgaccgtattctctttctgctcctgcggagtcacatcttcctgtgtctgcgcgaagaccggcagaccggctaccaacatcaggcagagcagaaatatcggagctactatgttacgcaactgtttcatttttattcttatttttctttttccgtttcaggttcacttcaaaggagaagaagaaccacgtttcatatatcagatacaacagatagaacgagataaacgtcagcaagaaagccttggcttcttcgcgtactgccagacaataaatcagcagcagaatcagcgagagaatcatttttatcatcttcattgccagatacagcagcgacaacttctgcggagcatgccgccgacacgcatcgaacatataaatactaaacaaaccgaagatatagaaatataccggtataaacggatatcctccgaaataatgccccggcaaggctatgtgtaaaatcactgctcccgctgctccgcttagtatagcaaacagcgtattcagtgcgataaaattccgtttagtcttactaatgttcaccatgtcgttgtgtttttctgctgtatattatccatctcgtcttccttacgagacacacaccgaagctgtcccgtcactcatttcaacaaaaccaccctgaatatccaatgtatgctcctcgccgtccatcgtggtataacccaacgttcccgctttcaatgacgagacgatcggcgcgtgtcccggcaggatagaaaacgatcctaccgttcccggcagtgtgacaatcttcacttctccgtcgaatacgctcttttcgggcgatacgatacttaaatgcaattctttcatcatggaatgttgtttcgattactttttcgcttgttccagcaatttcttgcctttctctatcgcttcttcaatcgtgcccacgttcaggaaagcctgttcggggaggttgtctacctcaccgtcgagaatcattctgaaccctttgattgtatcctcgatgcctaccatcacgcccggaacgcctgtaaactgttcggcaacggcaaacggctgcgaaaggaaacgctgcacacggcgcgcacggttcacgaccagtttatcttcttccgaaagttcctccataccaaggatggagatgatgtcctgcaattccttgttgcgctgcaaaatctgtttcacgcgctgtgctacgtcataatgttcctgtcccacgatgtgcgggtcaaggatacgggacgtagaagccagtggatcgacagccggatagatacccaattccgtaatcttacggtcgagcacggtcgttgcatccagatggctgaaggttgttgccggagcagggtccgtcaagtcatccgcaggcacatatactgcctgtacggaggtgatagaacctttccgggtggaagtgatacgttcctgcatcgcacccatttccgtggcaagtgtcggctgataaccaacggcagaaggcatacgtcccagcagagccgagacttccgaacccgcctgcgtgaaacggaaaatgttatcgataaaaaacaggatatcacgtttctcaccttccttgccggcatcacggaaagattccgctaccgtcagtccggacaatgccacagaggcacgtgcgcccggaggctcgttcatctgtccgaaaatcaaggatacctgcgacttttccagttcattatagtctactttcgaaaggtcccagtcgcccttctccatactttccttgaaagcctcgccgtagcggataacgcccgactcgatcatttcacgcagcaagtcgttaccttcacgggtacgctcgccgactccggcaaatacggagaatccgttatgtttcttggcaatattattgatcagttcctgaataagtacggtctttcctacaccggcaccgccaaagagtccgatcttgccacctttggcatacggctccagcaggtcgattactttgatacccgtgaagagtacctcctgcacagttgtcaaatcttcaaactttgggggatcacggtggatggaatatgcgcctgtacggtcgagactcttcataccgtcgatagagtcgcccactacgttcatcagtcgtcctttaatctgttcgcctatcggcattgtgatcgggcctccggtgggatacaccttcatgcctcgctgaagtccgtcagtgctgtccatagccacggtacgaaccgtattctcgccgatgtgttgctgaacttctacaaccagtattttgccgtttggcctctttatctccagtgcgtcgtgaatgcttggcagcattaactctgcgtccgtaccttcaaagtacacgtcgaccacagggccgatcacctgtgagatatgtccgataatctgtgacataagcaatctttatttatattattctttctttacctatcgaattttagtagcatgacaaggaacgtttcgcgttttatctactttaatctactatagtaaacagttaaatttagcttttgttcaatcatgcccgatttctttttaacaaaatagttaaataaacaaccgcgcaaatgtagaaacaaattagcatcgttgttcttcctttttcattatttgtcgttcaataacacttgttaggccaacaaagactacaaacagaccaatatcggaacattccaattacgattgtatagtaaaacaagcctgttaattataaaatatcattaaaactatgacttaacatcaagttttcccattcaacggtaatattcaaacacttaaacgagtgataaaatagtagcatatgcaactagttttatatccgggcacgtacatcctattaaacactccccatttgcctgaagcggaaaagttttcggcaagaaaattataaattccttaattttgccactttgttaaatgtcagcagaaaaaataagaagcaaaaaacactcttctgataaaaaaagaagaaatttgctgcattattaatcctaaaaattatggtaaaaaaaaccttttggcttttgccgaaaaaatcggcaactttacgttaaacgtaacaatggtagacaaagcaggcaatccgttgacagtagatgatatatctcaatgtcacctacccggattccccatcttatttactcaaaatgaattacttgaaatccttgcaaaagagattttcaagcaacagtttctttggaaatccgtacaggataaagacatcaaagagtgcaacaaagaagaacggatcatcaagcagataccgctgatgccacgctgtccggatgtactgaaagggctgttccattgcatcgaaatccgcgacgaacgctctccgaagcatgccatagcctataaaagctgtctgggaaaactggaggagatggtgaaagaccaatgggacgattggaacagaaatcagtcctaataatcgatttggtaaaaaaagagaagttcctaccttcgcagccggaagcccgtgataactacaccacccgcttccggcaacttatatattatatttcaaatgagaaagcacatgtaccaagtgtcactatttatcaacacttggagtaaaactcccacgactataacttttgaagattttttcgcaatggtacgcaacggacattggaaagtgcctacggaaggccaccgcagctgtctggcaaaagaccgaaaacacgacgcgcaaaccatcaaagacagcatggcatgtgtcatccccgcaggcatatgcaagaatggacacgcaaaaaacaaccttacctccctgtcactcgcactctgcatcgacatcgaccatacggacgaacagacaaaggatattttcgtacgtgcctgcctgctcgaatacgtgttgggagcgtttatcagcatctccggccgtggcgtgaaattgttcattcgcatagatatcgacggagtaaacgattatcctgccatttatgaagcgacggcaaagctcgtttccaccgttctcggcgtagagaacgacgggaaatgcaaggatatcacccatccctgcttcggatcatacgacccggacgcatactacaacggtgacgcaaaggccgtcaacgactttctgccgaacggtgcactcactccgcgcgtcacctacgctcccgtcacttccgctccccgcaccacctgcactcccacctctttctccaacggacatccgcctgcaaaggcgggcaaccggatttccgccgctcccttcgtacagtcctacctcaccctctaccctgccgtaacgggcgaccggaacggaaccgttttccggctcagctgcgctgcctgcaaacgcggcatcgaccgtaccgaactgaccaccgaattggttcgcaccttggaagaagacaacttccgtgaacccgaaatcgcacgtactgtaaaatcagcttaccagaatataatgactgcggcagagacggaaagcttcgaaaatcctccttcaaattccagtaaagtccaaaagtccgttataggattttcagaaaacgaaaatccggcagaaaaggaggatgaaatcatcggagaagagctcagagagcagactccgacctttcctgacgaaatttacgatctcattcccgccatcttcaaggagtgcgtctccatcgcaagagatgagcgtgaaagggacggactcttgttgtcatgtattaccacgataagcagcatgctccccagcgtaaacatccgctacaaccgacggaattatcagcccaacatctactgtatcgtcgtagcttcctccggtgccaacaagaacctcatcggctatggcatacgcctgcacaagcactattgtgagtattgggagaagcagagtctgaagatcgaaaaggaatacaagaaagcactcagggactacaccctctccttgcaggcgatacgcaaaaagaatactgccgccaccaacctgccggacgaaccggaggagccgaagctggcatttccgctgatccctgccgacatcagccgtgcacagctcatcactcacctcatcaacaaccaaagttgttcttccttgctcaccagtaccgaagccagcagcgtcagcacagcccgcaaccaagattacggacacttcgacgatatcctctgcaaggcattcgagcacgaactgatcagttcgtcctacaagatcaacggacgacatccgctgaaagtggaatatccctccctgtcggcttttctcaccggcactccatccagcctcattttattcatcccgaccatggagacagggctgtacaaccgctttctgatcaataccttcagacttccggcagcatggcaggatgtgttcgcggaggaaaaggtgcgggcggacgatctcttcaacgagttgtccatgcgcttcgcacagatggcattgtttctgaaagattctcctacggaagtaaagctgacagatacacagaaaaaagaattcaaccgggtattcacgcaactgctcaaagatacggaccagttaggtaatgatgacctgctgggggtggtgaaacgttatggagtgataacggcacgcatctgctgcattttctccgccatcgacaagggaaccatgagaatggaaacacccgaagtatactgctcggacgcgcatttcaaagcagcgctcgccatcgtgctgtgttgcttcgaacatagtaaactggtcagtacttcggtaaaaagctctgccgaagatacgaaaccattacaatcgcccgataatctctcgcgacttctgacgaaactcaaaaagagtttttcagccaaagaagcatgtgctttgggagaggaattgaacctctcaagaagcaccgtttactacttattgaataaaggcattaaagcagggagaatcagcaagttaggtcacggttcgtatattctgaaaatctaatatggactttctggactttactggactttgaaaggggaaattcgtgacttttacttcattgtcacaagaaaaaaacaataagtcttattagcatatcgaaattagctattagcaaaaacaaattagctaatagctaatttcgatatgctaatagctaatttgtttcttccttacagacggacgacttatcaagaaacagattcacgactcatcgaaaaacagattcacggctcatcgagaaacttcacgatcagcctcacctgtctgctgctataagcatgatcgttttttccttctccaccgctatacatagcgtcataaagttctttattatttctgatccatccccgtagtttctgcatggcataaatcaatggcaaatgtggattgtacttgtgagccagctccgacttcaaatacggacggatgacaaacggttcttcttccgcttcttctttttctgttttcatatcgttgttattaagttctttcgtacttcaaatatactaaaacatatttgcgcacacaagcaaacaagtaaaataaaatcaatcagaaagaaagtaaatacattctgaaagaaagtacgacgaagtacgataaagtacgtattctcatggcttaagaataggctacctttgacacatcgaaagaaagaaacagagctcattctctctcccgacattgatcgagtgacagcaatcagtaattattaatttatatttttctaaatctttaatttatcatcatggcaataccatttaaaagaatgggtcgtaaagacccgcgaaaaattgacggggtgctgaagtaccacccccaactggtgacgatgggccaaagtgtagaccttgacggcatcgcctacatcatgaaagacaagagttccctctccctgggcgacatccaaagcgtactgaccaactatgtggaggcaatgcgagcggcgctcttcgacggaaaatcggtcaatatcagagacttcggtgtattcagtctatccgcccatacgctgggagcaaccacgaaagaagagtgtacggtgaagaatatcaaatctatacagatcaacttccgcccttccagcagcgtccgccccaacctgacgtctacccgtgccggtgacaagatcgagtttctcgacctcgaagccccgaaaaagaagaaaggcgacggatcaggagaggacaacaaccccggtggcggtggaaacgaaggcggcggaggcgacgaggaagctccggacccgacagtgtaagaagtggagagttgagagttggtaatcaatgtacgagggattgatagttagaattagtggctttatgaggaagattcatttaattgtgattcactgttctgcaacgcgggcagacaaggagttgacggcttttgatctggatacgatgcaccgccggcggggatttaacgggacaggttatcattactatatccgcaaggatggaacaacgcatcttacccgtccggtggaacggatcggggcacatgcgaaaggttttaatgcggagagtatcggaatttgctacgaaggcggtctggactgccggggacgcccggcggacacacggacaccggaacagcgggcagcgctccggctgctggtgcatcagttgcaagagagatttcccggttgccgggtgtgcggtcatcgcgacttgtcgccggatcgcaatgggaacggtgagattgagccggaggagtggatcaaggcgtgcccgtgttttgaggtaaaggaggaaagttatgccttgtaatcattcattcggtaatgattcacttagtaatcaatcatataaagagtcggaaaggaggtgtgtagagttatggcagtcaagagatccctttgggataccattttgaaagtagtcatcgcagtggcttcggcagtgctgggtattgtaggcggtaatgcgatgagtctgtaagatcagagaaataacaatttcataaacgtgagagagaggatgcaggttcagacttctgtcctctctctttatttataaatctaagtacagtataaacgttgatattcttcctagaaagaaggagttatcatcagaagtagtagcgcagcccacccagcaggttaaagcgggtgattccacaacgttcgtcttctttcagcagcatccagtcctgtttgggcatacttccaccgatcccgttcagagtcaagccgagtccccaattagatgaaagcatgtactcaaatcctaatgtggcatgaaggccgaatccggcagcattgtagaaaggatcatgataaaggaaaacgccgacaccaacgcctgattttaagatccatctgtcaaattttgtacggcttacccactccggagctatataggagaacatcatgtcgccaccggagaatgacttcttgaaaccagcatattgaagtccgattcccatcccaccgttccagacatgttcgtaagcgagcttccattcaactcctcctttcgaatctaacgccctaccgttgatatcataaatcttgctgatcacccatccatatccgaagctcgcttcaaacgtgttggcaggcgcttttctgctttctgcatagtctttagcaataaccaggtcgagatctattacgtcttgtacaggatttgttttcagtgtatccacacttttatccgacaaccgcagcatcagtccggaaatctgatgacaggaacttccccaaaaagaaggtttctggtgattagtgatggcgagtccattgccaccaatctttcctgtagcctcttgtgcaagatgtaatacctgatcataacggcaattcgtagaagtaccccgatccactactgatacacgcccgatagtctcggctgtattgggcactttttctcccaaaccgatgacatagaccgaatctgccggaataatacccggataggttcttacaatgttagtgaccactttaggtgaacaggaagtcagtaatagcatagcagtagctgccaatagtttagtctttttcatgtttttcattattagttatataagaggagatgatgagagagaatcaaaagcaatattcactatccttttgcttttgactcactctcattctttttatttagtatacctctactttctcggcgattcgtttcgctttatcacgcaacgcatccagatcggagttcagcggtgcatagcaaagtacgactcccatgcgacggttgacgcgggtaaacggcttgccgaagatgcgcagataagtgtcttcttctttcgtcacttcttccatgccacgatattgaggacgttcctgactcgctatcggagaaaggataacggcacttgcaccgatccgctcctgcttgatgccggggatgggcagaccgagtacggcacgcaggtgaagttcgaactcattcagattctgcgttcctgccaatgtcaccatgcccgtatcgtgcggacggggagaaagctcggagaagtagactccgttttcatggctcaggaagaattccactccccaaagtccggcaccagtcaaggcacgggttactttttccgccatttcttcggcttctttcaagtgtgcagggtcgatgtgtgcaggctggaaactctcacggtagtcaccgcctttctgtacgtgtccgataggaggacagaacagcgtaggtccgtttttctgtgtaacggtgagcagggtgatttcactgtcgaacttgatgaattcttcgatgatcagttcgcggatatcgccacggctgccactgcatccatattcccaggcatgttcaagctcgtcggcactcttgacgagagactgtcctttgccggaagaagacatcaacggtttgacgacacaagggaaaccgattttggcggctgcttccttcaattcgtccagtgtcttggcataaaaatagttggctgttttcaagccgagttctttggcggcaaggtcacggatcgccttacggttcatcgtgaagttgacggcacgggcactgggcactacctgaattccttctttttcaaagtcatagagacgctctgtgcggatggcttctatctccggaacgatgatgtccggatgatgtttttctacaacgcgttccaatgcttcaccgtccagcatgtcgaagacttcaaattcatcggcaacttgcatagcaggtgctccggcataagaatcacaagcaatgacgtgttgccccttgcgctgtgcagagatcacaaactcttttcctaactctccggaaccgagtaacaatattttcttcattattttgagtgttttatgttagtgatgcaaaattagtatatttctttttattaatgacgtaccttaggatatttattgtggaaacggaaaccgagtccgagcatcagatagttgggcgtctggaagttctgcaaattgtatccgatgtgaagaaaggaactgcgggtaacggctattttcaatgcaagaatctggtagaagcctctcatatcgccacggctgagcacgttggctcccataccgacgccgatggtaaaataaggcatcacatattccgcacgtcccgaaagtcccaaggccagctgatgctgaatgcccggtttcaggaactcacgtttagaactgctgctcccatattccacaattacatcttccctatatacattggcactgccatcataaacaccgtccagtgaagctcccacgcgaaacttataacccagattatacatcggggcaaaattgaatccggcaacgggatacgcattgggagatgcgatctgcttctctcctacccacactccctttcgacgccatgacccgaacagcacgacatcataactgatatggcggggaaaacgggtggtgacaggctgatagagtgatttcgagaggtcttcttccgtacgattgaaattgtagacgagtccgatcttggctccggcagtattgattcccgcattcgggaatttagtgttaccattggagaagtgcgtgaaatcgcctccgacaatcagatcgaagtaacgggaaaacgcccagtttatgtaaactccggcattgatataagcattcatccgtgaaccgaccgcaccattataggaattataataattgtcgtatggcttccatccggcggacaaaccgaaattccactcataattgagcgaggcacggggagagaaacgggcaattcgtgctccttgaaacacatagaatgagaaaggatcgcccaactgttttttatcaccaaaggtggtaagggatacaccgataccctgataagctccaccgtaaatacggtcggcacaagtattggggcgaaacttgaacgagtatttcaagtgggcggcaaacgatgtctgaatcggtttccagcgttcgttctctccttgcaggaaggggttggtaggaaatacatattgcggacgggcttccattcccaaacgatggataaaaccagaagactcctgccctgccaaaggagtcttcggcaggcaaaacatgatggaacaaagaacgatggttttccatctcagggtcttgtttctcatagtgccgtcattgttagtctccagatcctgacggtttcataaatcaagggtctcaataaacttggcaacatgataaccatccatcagtccgtgatgacaagtgacggaaatggggagcatcagcttctctccttcccgaaagtattttccggtggatattttggggacgctatcgcccgaacgcatgttcgtagggtgtttcatatctgtaaaggccagccatgggacagccgaatagtgaatggcgttgggatggaaagttcctcctttgttcagtccggtggtggcttgcagccgctccatttcggttttcgccttacggataaaggtgagctcatcgggatcgtactcaaaggcggcaaaagaaaaagtatgatcggcacgccctactgtcgcttcgggaagaagactgtcatagcagactaccttgtcgccctcgatgcggtagcggaattcctcgactttgcttgcggcagtgatgatacgatgtaatagtaaaagagaaaaggagacgcctttgtctttagcctcctgataagaacgggtacagtctacatgaactgtcactccgaaaaagggatcatcgaatgcgctgaaatgttcaaaatgctcttttctgttccatgttgcaatgtcaatgatcttttctatctgattcatcctaaatactctttttattataagtagtgactaaaaagtcggttgtatctacactagggctgactaaaagtcggcctctcagattttgcttttacttaattagtaattataatgattgggagagacatttgtctgtatctgccattcggacgactgcggaggaggaagaatgacagactggacccaatcttgttttaaatcctactgatgctgctcgcgcaacaggtcgttcaccgttttcaccggattgaaagtggtaagaggaacttctacgaatactgtgttccagtcgctcatcgcaccattccataagccgggaagttcaagcgctttcaggtcttttccgttctttgatttataagaaatgaagccagtcgccttatctacatatttcaccaggtcgaacttgtgacctttataatcgcgtacggcacaaaccaagtctaccggattgaagtgcgtacccttttcgaacatttcctttttggcaggatcgttcatgtcgatctgagagctttcgaggatttgcagtgagatagttccgtcactgttataagcaaggaacggaccgccacccggctcacctacattcttcaccataccgcatacacgcatcggacggttcaatttgttcttcaggtagatcaccagttcggcatcttcgaggttcttcgtttcgggattcttgcagaaaagttgtttttgcaggaattggagaatttccatgatttgctcgtgcgtatactttccgctgtcaagcagttcgaggtattcgaatgcctttttctgcaaggacacgagtacgccggcaatcagttttttataagtaacggtgtcggctttcagtttatcgggtactacgttgtcgatattcttgatgaagataatgtcggcgtcgagatcgttcaggttctcgatcagtgcaccgtgaccacccggacggaacaggagtttgccgttgtcgcggaacggttggttgtccatatcggcagcgatggtatcggtattcggtttctgttcggagaaggtgatgtaatagtctactccgtagcgtttgccaaatgcttcggctttctcttccaccagcttcttgaagagttcgcgatgctcggtagagacggtgaagtgtacgttgacttttccactctttccggctgcatacatagcgccttcggcaagatgttcttccagtggagtacgtgaaccttcgggatatttatggaatttaagcagacctttcggaagtgctccgtagttgagtccggcagtttcgagaagggcagctactacagctttgtaattaccttcttccatcagccccggaatatcttttccggctgtacgctgacaagctacattcaagtcgtcgaagaaagcaaaatccctgattccgtcgaagaatgcctgctcaaactttgtagtaggtttgtcatactctgcggacagaaactcgaacagattcttgaacatacgactggcagcgcccgaagcaggaacaaacttcacgatgattttatccgtattcttataagcatcccatgcagccagatatgcgttcttttcttctgcgtcaggagccaatatgcctttttctatggaagcggcagcatccagtttcaaataaggaaaacccgtctggaagcaagccagctgttctgctatctgcgcctccgtgatgcctttcttggcaagcaactctttgtcctgtgtcgttatcataatatctatttttattaattgatgcccaaaaatacaaaatgttatttacttcttgccgaataaccgggaaaaaaagtaattttacgtcgaattaacaagattgaatatggacgacttttttacatcagaggaaaagaaggagcttttttcactctacaggcatctgttgcaatctgccggagatacgattttctggagggattgccaaaaattaaagaaacatcttatcaaagctgcccagtgtaacgggctgcaacgcaataacttcgggatgaatcccgtcatcagagatttacaaacggcggttatcgtagccgaagaaatcggcatgaaaggttcgtgcctggtcggcatcatgcttcacgaaatagtgaaggcacatatcctgtctatcgaagaagtgaatgccgaatatggcgaagatgtaggcagtatcatcaaaggactggtgaaaacaaacgaactgtactccaaaagtccggcgatagaatcggagaatttccgcaatctcctgctctcttttgccgaagatatgcgcgtcatcctgattatgatcgcagaccgtgtgaacatcatgcgccagatcaaggatacaggcaacgaggaagaccgggtgaaagtagcgaacgaagctgcttacctgtatgctccgctggcacacaagctgggactttacaaactgaaatcggagttggaagacttgtcgctgaaatatacgcagcgagaaacttactattatataaaggagaagctcaacgagacgaaagcatcccgcgacaagtatatcgcttctttcatcgatcctatccagaagaaggtaaaggaagccggactgaagttcgacatcaagggacgtaccaaatccatccattccatctggaacaagattcagaagcagaagactccgtttgaaggtatctatgacttgttcgctatccgtatcattctggattccgaaccggacccggccaaagaaaagcaggaatgctggcaggtctattctatcgtaacggatatgtatcagccgaacccgaaacgtctgcgggactggctctcgattccgaagagcaacggttatgaatcgttgcacatcactgtgatgggtccggaaggcagatgggtggaagtacagatccgtacccgccggatggacgagatcgccgaacggggactcgccgcccactggagatacaaaggtatcaaaggggaaacaggactggacgaatggctgacttcggtacgtgaagcgcttgaaaatgcggataacgactcactgaaagtaatggatcagttcaagatggacctttacgaagatgaggtattcgtattcacgcctaaaggagacttattcaaacttgccaaaggggctactgtgctcgattttgcattccatattcatagcaaactgggatgcaagtgtatcggtgcgaaagtaaacggcaagaatgtacagctcaaacagaaactgaacagcggtgatcaggtagaaatcatgacgtcgaatacccagactcccaaacaagactggctcaacatcgtgacgacttccaaagcccgcaccaagatacggcaggcactcaaagagatggtagcacgccagcacgatttcgccaaagagacactggaacggaagttcaaaaaccggaagatggagtatgacgaagccaccatgatgcgtctgatcaagcggctgggctttaagaatgtgacagagttttatcagaagattgctgacgagacattggatgtcaacgacattctggataaataccttgaacagcagagacgggacaatgacacgcacgacgagattgtgtatcgcagtgccgaaggatataatttgcaggcaactcaagaagaacctagctcaaaagaggatgtactggtcattgatcagaatctgaaaggactggaatttaaactggccaaatgctgtaacccgatctatggggatgatgtattcggatttgtgaccgtgagcggaggtatcaagattcaccggtcagactgtccgaatgccaatcagatgcgtgaacggttcggataccggattgttaaagcgcgttgggcagggaagtcagtcggtacgcagtatcctatcacgttgcgcgtagtaggtcatgatgatatcggcattgttaccaatattacttctatcatttccaaagagaatggaatcagcctgcgttccatcggaatcgattccaacgacggactattctccggaacgcttacagtcatggtgggtgataccggacgactggaagcactgatcaaaaagttacggacagtgaagggagtcaaacaggtaagcagaaactaagcactctatgctaacagcaaatctgttgacaggtctttaataaaaagactggcattatctccgtcaggataacgccagtctttttatttatgatagacaatcatgtcacggaaatagtgcgaaacgatttatctcactttctttctcttataatatggatatgtaaccagtataaagaaaatcaaagcaatcacagctaccacctgtcctgtatagagcatcttatccgcttccaaatcgaagtaacacgcaacagctattccggatgcgaatccgacttcgctggccaacagatgagtggtatttgccgtaccccgctgacaatgatgtgacagtttcacgaacatgaccagaaattccggcatcaccaaccccagtcccaaacccaagagtatggaaggtacgcctaccggaaagccggaggccagcagagtgatggctacaatctccagtatgatgccgacgagcaccagccgcaaagttttttctttcagaataaacagacgcgccagcagcagggaggcaagatatccgatgcccgtaccgacaaagaacggtatagggattccactgcttccccatacggaatcgttaaggaaacggtgtacaagcggaatcaacaaccccggaacgaaggtgatcagaatcatattgatggcaggcacccatccccgcaacagcaaaaagcgatcgaatgaataaagcctggtcacaatcggtgcacggaaaggcacatatactccggataccatcaaaacacctgctgctccggtaatcaccgatacggacaatagatttttaaaggaatagctctgataaagccagacacccagaacaatgcctataatcatccccagacgtgccatccaggagaaactgacatttccggcactgcgaagtgtagcgttcgttatgtcaatggcaagtgtgattcctgcggtggtagcgattccgaaagccagtccctgtacggtgctcaacaagataagttccgtgatgttcgtcacaaaggcgtatcctgccgttgctgccaccatcgtggcaaaagagaacatacatacgtacttacgcttataagcatctacgagataagcatggaacggaccgataaggaacattcctaaagtgaaaaaaagaaagatcactcctgtctgtgccaccggtactccgagacggtctgccatctcaacggaaagtaccggaaacaagatatacaaggagataaacaacagcaaattagctacgcatatccgcataaaatgaactgtccacaatttaactgccatatactgttttaatattgttccttctcgttagggaagtcgcaattcttcacgtcggatacgtaacggctgatagcgtcagtcatcaccgtatacaggtctgcataacgacgtaagaagcgcggacggaatccgttgttcattccaagcatatcctgaatgaccaatacttgtccgtcaacatgaccaccggcaccaatacctataataggtatcgtcagttcggaagccacacgttctgcaagagtagccggtatcttttcgagtacgatggcaaagcagcctgcctcttcgagaagatgagcatcacgaatcagcttttcagcttcgttgtcatctttggcacgtaccgtgtaagtaccgtatttattaatagactgaggcatcagtcccaagtgtcccatcaccggaatacccgcactgatgatacgcttcaccgtatcgatgatttcttctccgccttccagtttcaaagcatcggcatggctttccttcataatgcggatggcagaagcaagaccttccatttcgttaccttgataggaaccgaaaggcatgtctactacgaccatagcgcgttttacgccacgtactactgatttagcgtgataaatcatctgatcgagagtaataggcaatgtagtcacattacccgccatcacgttcgaagcggagtcgcctaccaaaattacgtccattcccgcaccatctacgatctgtgccattgtgtaatcataagaagtaagcatagatattctttcgcctctttgcttcatttcaaccaggcgatgagtagtcacctttcttgtgtcatctgatatataaccagccatgtttcttaaattttaaattaaaactagaaattaaataaggcgtcaacgccatcaaaaattgcggcaaagttataacatttctttcataagtgagaaagaaaaagaaaaaatcctttcaaacacctccccaagttaatgagaaggcggccaaaaagacaaattaagaagataataagaaagaactaacggtgcaaggccaataagtgttcaaaggtcatttccgaaaagtcatctattatataatgtgcttttccggtgatggcctctcttgtattggtagtggcaagaccgataacagtggcaccggaagtcattccggcttgcagaccgtggaaggagtcttcgaacacgtacgagttttcgggagtagcaccgaatatttccataccgagcaggaaacagtcgggagcgggtttagaacgggcaaacatttctccggtcaggatgcggtctaccattcctttaaattcgggatgggcgttatagacgttttgcatcttctcttcgttggagctggttacaacggctatttttgctccgtgtttacgaagatcggcaataaaagcttctacaccggggatgtactcataggacatgcttttctcataaatattgagtccggccgtaatctcttgttgagcttcggggaggtccgagaaatatttctcgtaaatctgggtcagcgtctgtcccttgatgcgacggccgaagtcttcttcattcagatatttacgtccctgttcatcccagaaaacagtgtactgtgtttccgtatccatgatgacaccatcaaaatcgaacagtgccgcaattgtctttgttgtatccatacgtaatctttctttttacctaaaacgttaaaccttgtgtattgaattgtgcaaagttccgaataatcatcgaatcaggcaaataattcgtacctttgccccacttaaaaaaacgtaacattcgttttcatccaacaatccatacgagcgcatgagcaaaaacgatccgcacatattaggaaaagaaagcatcggtaagctactgttgcaatactccattcccgctatcatcgggatgacaatcacgtctatctataatatcatcgacagcatcttcatcggtcacggtgtgggtgcgatggctattgccggactggcggtgagctttcctctgatgaatctggtcgttgctttctgtacactcgtttcggcgggtggttctaccatcgcttctattcgcctgggacagaaagatatgaaaggggctacggagattctgtcacatacgctgatgctctgtatcacaaattctttctttttcggtatcctgtcttttatctttcttgatgatatattgactttctttggtgccagtcccgacacactgccttatgcacggagttttatgcaggtgattttattgggaactcccatcacatacacgatgatcggcctgaataatgtgatgcgtgccaccggatatccgaagaaagcgatgcttacttctatggtaacggtagtagcaaatatcatcctcgctcctatctttatctttcactttgaatggggaatgcggggagcggctacagcaacggttatctcacagctgatcggaatggtatgggtggtgagccacttctgcaagaaagacagtacggtgcattttgagggaaaggtctggaaaatgaaaggaaggattgtagagagtattttcgctatcggcatgtctcctttcctgatgaatgtctgtgcttgtgccatcgttatcgtgattaataatagtttgcaggaacatggaggcgacatggctatcggtgcttacggaatcatcaaccgattgctgacgctttatgtcatgatcgtattgggactgacgatgggcatgcagccgattgtaggctacaacttcggagcacagaagatagaccgggtgaaacagacgctaaagctgggaattatttccggtgtagtgattacaagcagtggctttctgatttgcgagtttttccctcatgcagtatcggcagtcttcacggatagtgatgagttaatcggacttgcggtggacggtcttcggttgactgtacttatgttcccgtttgtaggagcacagattgtaatcggtaacttcttccaaagtataggcaaagtaaaaataagtattttcctttcgttgacgcggcagttgctttatttgctgccttgcctgttgttattcccgcattggtggggactgaagggaatatggatcagtctgccggtatcggactctttagcatttattacggcagttatcagtctgatgatttatataaagaaagtatcgaaagaacatccgatagcagataaagtggcggaataaagcaaaaaggacgctatgctaaaagatatatcagtatgaaaaatatttaggcacgaatacacggattaagattacttctgcaatgaatgcatctcataaaagccgcgttaatccgtgcctaaaagataataatattcttattcgctctttatacttttcaccggattctcattggcgatgtgccacgctttcaacacaacgcaaactacgatcagcaataagacaaacagcgccgtacccacaaacaataacgggttcatataaatctgttcggcaaactggtcaagccatgcctttccaacgaaataggaaacaatggtaccaatcaatatggaggaagcggagacatacagaatctcgcgtatcaacagacgcaaaatatgagaggcttcggctccattcactttccggatggctatttctttgcttcgacgttgcgtttcatcattcacatatccgatcaatcccattattacaatcagcagaataaagcttgaagtgatccagactgaattacggaaacgatatacactcttgtatatatcctttatcataccgtctacagaactgaaatgcaaggctacattcggaaatgtcttatcggcaaactcgttcagacgtttcagattttcatcatacggctctttcaaacggacatcaaatacatgattggtattctccgatcctatcaagacaataggtgcctgagttgaaaagaagctatagttgcggacatcccggaagacaccgacaatcgtaccctgtatatcattcagtttctttcctaccgccccatctgtccatttcatcagacgtaccaactcttcattcaccaataaatcgtcctgtttcttaagagtgctgccttcgataatctttattcccattacttcgggatagttataactgcaataattaaagttaagtgtagcgattcttttaccgtcattactcatcagtccgcgtgtccagtactgtccgattactccgcttgtagcaacagccactccctctaccataggctggcgacgcagttcatcggtgacatgctctaccgtttctttcggcaaccaggttcctgcctgaaccagtcccggaacgtttattcccatatcgcggctcatcagatggttgtattgcaggagcgttaccagcaacagccccaaaacaaatgagacacctgtgaactgtataaacaataacgaacgtttccaacccgttttaccatcagagtaacgacggaacacctgcgtgactggtatacgcgaaaacagccgtcccggtatgccacctgccaaaaggaaaagtatcacaatcgtaagcaaaggcacccatagtgtctcccacgcaaaaagtgaggatagacggacagaaagcaaatcttcgattatttcatgtgcgttgactatcagcagaagactaagaagtacggaaaagataacaaggattcctgtttctgccaaaaacatgccgaagatatttccggaactggcaccactgcatttatgtactcctactcctttggcacgacggcttagggtggcaatagatatcagcatataattcatgatggccacaaagaagatagcgaatcccagaaagccatatatgatcaaacgcttctgcacatcggaagatatcaaatgatacttcaccaatgggatgacactgaaattcattttccagtcatcatactgggcaggagtgtatttttcgattacccgttggatgttgtcattcaccttgtcaatatccgcagcattacgcaggcgaagaaacgtgtaaaagacatcatttcccttccagccatatcctccctgatatcctccatcccgatggatggagacaacaaagtcgtgagtgagcaccgtattctccggcatatccttgtatacaccacgaatagtaaaatcattttgcctgtctgctttaagaattttaccgatagggtccgcatctccaaacgtttcacgggcaaaatgctctgacacaaacacacttcccggcatgatcatatctttcgggttcccttttaagacagggataccaaaagtctggaagaaacaagtatcagcgtatatatagttaacgtccgataataatttgtcttcgtaatatatactcatcccttgtccggtgaggacacaactggcaaactctatttcttcgggcatatcctgcgccaaagtagatgcaaccacatcaaaaagtgtgtaatcataattgttgccgtcgtctcccattgtctcccccgtgctaaggttagtggtcaggcaacgtgcaatagccagtcgttccggttccggatagcaacgttcataactcaattcaaacgcaatctgcgaaaagagcaaaataccaatagtaagtcccagcgaaagagaaattaccctgatgatatttgtgccgcgttcgcgcagtaaggttcggatgctataatagatttgtctcattgtcgttccggtttatgccgttacacttgccactacactaccgtcaaacagatgtacggtacgatgtgcgaaactcgcatcgtgctgtgagtgcgttaccatgataatggtggttccctccttgttcagttctgtcagcaggttcattacttccgcgccattcttggagtccagattaccggtaggctcatcggcaaggataagctttggattagtcactaccgcacgggcaattgccacacgttgttgctgaccgccggaaagttgttgcgggaagtgtttggcacggtggctgatattcatccttttcaagatgtcttctaccatgcggcggcgttcggaagatttgataccaagataggtcagcggaagttctacattctcaaagacattcagttcgtctatcaggttaaaactctgaaatacaaagcccagtttgcctttgcggacgccggtacgttccttttctttcagtccggcaacttcttctcccaataatcggtaagaaccttcggttgggttatccaataaaccaagaatattcagtaaggtggacttgccacagcccgaaggtcccataatggcaacaaactctccttcctttacttcaaggttcacgtgatttaatgcgactgtctctacttcggtagtacggaatactttactaatgttttcaatctgtatcatcttgttcatttattatgttgttatactttttatttcttctttattcgctctttatactattgaccgggttttcattggcaatcttccatgatttccaaagtacgcatgccacaatgactgccagatttgcaattgctatcagaagataggcagcccaactgagcggaacatgttcggcaaacaaacccatccacataccattgacgtaccatgctgctaccactccgattaaaactgcaacaacagctacataaagcacatctttcaccagcagttccaagattccggttgcttcagaaccattcaccttgcgtatggctatctccttggaacgacggcggacctcatccgtagtgtagcctatcaatcccatcaacatcacaaaaaacattgttattgccgccagcatcgtagcattactgaaaacacgaacagagttataattctctttgatcatctgttgcatcgaccgaaattcgatagtcttatcaggaaatgcactctccatctccttattcagtttgagaagattctcggcaaaaggttctttcaaccggacatggatacaatcaccaaacctcttggtgtgcataagcagcaacggttgttgcgggctggtaaaacttccgatgcgataatctttcatcacgcccactaccttacatacgtatcccgaattataaaccgtacgattcagtatattgtttccccaatgcatccactcggcaaaagtctcattgacgactgtctcatcgtcaccacggggcatacgtccctccttcagaaccatccccatcatcttcggataatcatccggaacactgcaataacgggatgaaaatagtgactgtccgctttcatcattaataatcgttccactatatccgtagacaggatgataagtggcactggacacggattccacataaggcatattccggaaaacattcaaggcataatttcctttttcttcctcaccgaagctggcattggccaccactacacgctttggattataacccaaatctttattcaagatataataatattgcatcatcaccacatacatcagtccgcaaataaatgctacaccggcaaactggataaacagcaacggtcgtttccagccctttttaccttccgtgtatcggcggaatacctgagtaacgggtatccttgcaaacagtcgtcccggcaataccccacccacaacgaaaagtacagccaccgttaataaaggtacccaaatacgatccaagctgaacaaagcgcttaacttgacagctgccgtatcttcaaagaaatcctgaaaattcaataagatcaatcccatcaggatcagggcaaacagaatgataatcgctgtttcccaaagaaacatactcaatatggtcatgtttcctgccccattgcatttatgcacaccgaccgctttcgcccgataggaaagtgatgaaacagaaatcaacacataattcaatgaagcgatgaaaagaatagtaatacccagaatagtcatgatgttccgcatccgccttacatctttattgtcacggtatacatcacggatgggctttacaaaagcggtatatccaaccactttttgatcttccgcaggacgatacttctgtatcattgcgtctatccgggcattcactaccgacttatcggctccgggacgaaaacggatgaacgccagccagctgtcgccgcctctccatgagtaatttccccatttgcggctccatatcgacggcagagaaatcaccgcttcaggccttaccgtcgcattctccggtatatcagcataggtgccttttaccgtaagttctatctccttactgtatgagataaccttgcctatcggattctctgtgtcgaacatctttcgtgccaaacggtcactcaggtaaactacatctttttgggctaaatctttcaccggagttccgcttaagacctcgattcccatcgtctggaaaaagagggaatctgccgccagctttctgacttcaaaacggacactaccatgatagagaggatcattcacccaaaggcagtaactggtagccgcctccacttctttgggaaagttttcaagaattgcacccgctaccggtccgcaattttgatcctgcggttcgagttgttcgccattcatcgtaaagatggaaaagacttgatataagttttcataatccttaaagcatttatcaaagctctgctcaaaagccacgcgagcaaataataaaatactcattgtcagcccaagccctaaagaaatgaccttgacaacattggaactacgcccccgcagcaaagttcgaatgacataatagatttgtctcatgattatataatatattcctgttttttttatgatgcagtgcagataacgtgccacaatagtgagaatactcattctcaatcatttatagttatctgtcctatcatctactgtctaataattagacacatgcgtctaattattagacaaagacaatcgtatttcctttctcagtggaaagtatgcattaatgcctatttattgttccatttttcttatttcgcccaagcaatcgcccatatctcaactgaaaactctatcttcgcatcaagttttcaattaaataaattattctatttatggtaaacaagaatttatacactctcctggtctgcctgcttctggccggatgcgatctgatagactaccacccctacgatgtacgtatcagtggagagacagacgtaaatgctcataacattgaacaaatagaagctaagtgcaaaggaaagacaaccatccgttttatcacgatgggcgattcgcagcgatggtatgatgagacagaagactttgtaaaagaggtcaataagagagatgatatcgatttcgtcattcacggaggagatatgagtgacttcgggctgaccaaagagtttctttggcagcgggacatcatgaacggactgaaagtgccttatgtcgtccttatcgggaatcatgactgtctgggtaccggagcagaaacttatcaggctgttttcggacctaccaacttctcattcattgcgggcaatgtgaaattcgtctgccttaataccaatgcgctggaatatgattattcggagcctattcccaatttcggttttatggaacaggaactgacggacagggcagatgagtttgaaaaaaccgtagtcagcatgcatgcacatccttttgcagatgtgttcaatgataatgtggcgaagccgttccagtactacatcacccaatatccgggactacagttctgcacggccgcccataatcacggattcgatgacagaatcctttttgatgacgatgtgcattatattgtcagcgactgcatgaaaagtcgcagttatctggtatttactataaccccggaaaaatacgaatatgaactggttgaatactaaatatatgatccgcgcaggagtactgactatgcttctactcttccccagcctgctttcggctacttgcaagccagatacaattatcaggaactataaacccgactcgctgaaactggcaattaaggcagattctatcatagcctttcatgagggtgattctgcattcacaatagtcaaagcagacacagtacttccttatattgccgaaccggttcttcgcaccggctacgacagacgtgtacatcgcttccgcaaaaactgggaacgcatcattccgacccactctaaaatacaatatgccggaaatatgggattactctccttcggtaccggatgggattacggaaaacgaaatcagtgggaaactgacctgttgctcggatttatcccgaagtattcgtccaagaaggcaaaagtgaccatgacactgaaacagaactatatgccctggagcatcaacctggggaaaggattctctaccgagccgctttcctgcggactatatctgaataccgtattcggcaatcagttctgggtcagcgaaccggaacgttatccgaaaggatactatggtttttcaagcaaggtgcgtatccatgttttcatgggacaacggctgacctatgatattgaccctaaccgccgatttctggcaaagtccgtgactttcttctacgagataagtacatgcgatctttatctgatcagtggtgtaacaaatagctacctccgtccccgtgattatctgagtttatcattcggattaaagttccaatggctataaattcaaatccgaattttgaattatgaattactttttcgtaagtttgtagcgtacaaaccaattcggacatgagtaaatcaggaaccatcatcattgtagacgataataaaggggtgctgacagcggtacaaatccttttaaaaaactacttttcgaaagtcgtcacactgtcgtcaccggtcacactgaccactgcgatacgagaggaaacaccggaagtggtactattagatatgaatttcacttcgggcatcaatactggcaatgaaggattgttctggctgcacgaaataaagaaagtacgacgggagcttcctgtcgtactttttactgcttatgcggatattgatctcgctatccggggaatcaaagaaggtgcttcggactttatcgtcaagccctggaacaatcagaaactggtagaaacactacaggctgccgcctcatccgcacagcaaggacgtaagacaggaaacaaaaaggaaccggtcaacactccggcactctattggggagaaagcaagtccatgcaacaactccgaacactgatcgaaaaggtagcctccacagacgccaatatcctgattaccggtgaaaacggaacaggaaaagaaatgcttgcccgtgaaattcacgctctttccaaccgcaggcaacaggaaatgattgctgtggacatgggagcaatcaccgaatctttatttgaaagcgaactcttcgggcatgtgaaaggctcttttaccgatgcgcataccgaccggacaggaaagtttgaggctgccgatcacagcacattgtttctggatgaaataggaaacctcccctatcacctgcaagccaaactattgacggctatccaacgaagaagtatcgtgcgagtgggaagtaacactccgattcctattgacatccgtctgatatgtgccaccaaccggaatttgcaggaaatggtagaccgggaagagtttcgggaagacttactctaccgtatcaacaccattcatatagaaatccctcctttgagggaacggaaagaagatattgtccctcttgccgaaagatttatcatccgcttctgcaagcaatatgataaggaactgatgaaattcagtccggcagcgaaggaaaagcttaccgcgcatccctggtacggcaatatccgcgaattggagcacgcaatcgaaaaggtggtcatcattaacgacggggtgcaaatccctgcggaattgttccagttatcctcccgaaagacagaaactcccgagaagaatatttccaccttggaagagatggaagtacaaatgatacggaaagcgctggatgcctgtgcaggaaatctttcggcagtagctacgcaactgggaattacccgacagactctctataacaagatgaaaaaattcggattatgaaccggattctacaacaagtagccaaccaatattggttcagggtatcactgacggtcatttgctgtctggcgactatctgtttgggcgtgcatcagtcttatgtctggttcagcgtcagtgcctgtctgctgatcttaagtatcatctggcaagtccggctttatcgcctgcacatcaagcaggtgctcttcatgatcgatgcgttggagaataatgacagtgccttccgtttccccgaagagtccggtactcccgagagtaaacagatcaatcgggcactcaatcgggtgggccacattttatataatgtaaaagcagagactgcccaacaggaaaagtactacgaactgattcttgactttgtcagcacgggattgctggtgctcaatgataacggagcggtctatcagaaaaacaaagaagcactccggcttttgggactgaatgtatttacccatgtccgccagttgagtaaagtagatgctacactgatggagaagatagaaaattgttgttccggagataagctgcaagtggtgtttcacaatgaacggggaacagtcaatctgtctattcgcgtgtcagaaatcaatgtacacaaagaacatctgcgcatccttgcactgaatgatattaatattgagctggacgaaaaggagatagactcatggattcgcctgacccgagtactgactcatgagatcatgaactccgtgactcccatcacttcgctcagcgatacgcttctctcgatggtggaggacaaagacgaagagatcagccacggactgcaaaccatcagtgccacgggaaaagggctgcttgctttcgtagaatcctaccgcaaattcacacggataccgactccggaaccttcattgttttacttgaaagcattcatcgaacgaatggtggaacttgcccgccatcagaatccttgtgaccacatcacgttccatacaaagatcgatcctgccgacctgatcctgcatgcagatgaaaatctgatttcgcaagtagtcattaatcttctgaaaaatgcgattcaggcaatcggtgatcagccggacggacaaatcgacattcaggtttattgcaacgaaacggaagaagtgctgattgagattaagaataacggtcccgtcattccaccggaaatagtggagcacatttttatccctttcttcactaccaaagaaggaggcagcggaatcggactaagtatttcgcgtcagatcatgcggctttcaggtggaagcctcacgctgttaccggacaacaaggaaacgaaattcatattaaaattcaaataacagaccagcctatgacacctgcactcaccaataacccattattccgggggattactccggagaagttatccgccaatctggaagagatcagtttccacacccgttcttatagaaaaggagaaatactggcacgacagggagatgtgtgcaaccgtctcgtgatactgaccaaaggaagtgtccgtggtgaaatgattgactattccggaagactcatcaaagtagaagacattgccgcaccaagggcccttgcccctcttttccttttcggagaagagaatcgctttccggtagaagtgaccgccaacgaaccgacggaagtaatcgaaatccccaaagccagcgtactggagctttttcgtaggaacgagcagtttctggagaattatatgaatctatccgccaattatgcccgtaccctatcggataagcttttctttatgtccttcaagactatccggcaaaagatagcatcttatctgctacggttatacaaacagcagcaacagctacagatcaccctcgaccgctcgcaacaggaactgagcgattacttcggtgtctcccgtccttctctggcacgtgaactgtcgcacatgcaggaagacggtatgattatagccgaccggaaacagattactatcttacagaaagaatggctgatccggctgattcaatgaccaagagttcactccggtttcattatagctaatctttttttcattatagctaatcggaatatgattatagctaatttaatttagctcatagcatccgattttttttcgcccaatgtaacattggttacaaacttacctcaaactttccccctacttttgcgttcataatcaataagactaattaaaacgtaaaagttatgagtatgttctgttatcaatgtcaagagaccgcaatgggtacaggctgtaccttaaaaggagtatgcggaaaaacatccgaagtggctaacctgcaagacctgctgctctttgtagtacgaggaatcgccgtgtacaacgaacatctgcgccgggaaggacatccttctgaagaagcagacaaatttatctacgatgccctgttcgtcaccatcactaacgccaattttgacaaagcggccatcatcagaaaaataaaagaaggactacaactgaaaaacgaactcgccagcaaagtaaccattgcaaatgctcccgacgaatgtctttgggatgggaatgaagatgagtttgaagagaaagccaggacagtaggagtacttcgcacacccgacgaagatatccgttcgctgaaagaactggtacactacggactgaaaggtatggcggcttacgttgagcatgcgcataaccttggataccagtcgccggaaatcttcgcctttatgcaaagtgcactggccgagctcacccgcaatgatattacgatggaagaattggttcagcttactctggcaacaggcaagcacggagtttccgccatggcacaactggatgccgccaatacaaacagctacggaaatccggaaatatcggaagtgaatctaggtgtccgcaataatcccggtatccttatcagcggccatgatctgaaagacctcgaagaattgctggaacagaccgaaggaacaggtatagacatttacactcacagtgaaatgctccccgcacattattacccccaactgaaaaaatacaagcatctggcaggaaactatggaaatgcctggtggaaacagaaagaagagtttgaaagtttcaacggaccgatcctatttaccagcaactgcatcgttcctccgcgtgccaacgcttcttacaaagaccgtatctacatcaccggagcctgcggactggagggagcacactacatccccgaacgcaaagacggaaaaccgaaagatttctccgcactgattgcacatgccaagcaatgtcaaccgccgacggccatcgaaagcggaacgttgatcggaggttttgcccatgcacaggtagtggctttggcggataaggtagtagaagccgtgaaaagcggagcgatccgcaagttcttcgttatggcaggatgtgacggacgtatgaaaagtcgtgaatattataccgaatttgccgagaaacttccgaaagatacagtcatactgactgccggttgcgctaaatacagatacaacaaactggctttaggggacattaacggcattccccgcgtattggatgcagggcaatgtaacgacagttactcactggctgtcatcgcactgaaactgaaagaagtattcgaattggacgacgtcaacaaacttcctatcgtatataacatcgcatggtacgaacagaaagcggtgatcgtattgctggcattgctggcactgggagtgaagaatattcatctgggacctactcttccggccttcctttcaccaaacgtaaaaaacgtattgatcgaacaattcggaatcggtggcatcagtaccgcagacgaagatattatgaagttcttgtcataaacacaagacgtatatacattctaagccttaactattaaatataaaaaggaggggtgtcaacagtaactaaactggggctgattaaaagtcggtcctagtttagttactattaaccttgacacagtcctgaccatttcaagaacagagtcaatcgtccttcggtaatatcaaattaagaagtactccgaccaaagcagccagtccgatgccggataatgaaaagtctccccacgtgagaacagctccgccaatgccgacagtcaatgtcagagagacaatgatgatgtttcttgtacggctcagatcaatacagttattcaccagattacctattccggcacaagcgatggttccgaacagcaaaagcataattccccccaataccgcactcggaatggatttcaacaacgcactgattttaccgacaacggagaataagatagcggatatggcagcaatccggatgacttgcggattggtgattttcgttaatgacatcgcacccgtcacctccgaataagtcgtcaccggaggaccgccgaccaatccggcaaagcagcaagccagcccatcgcccaacaacgtacgatgcagaccgggatctttcacgaagtcttttcctgtaactgtattgactacgtatacatctccgatatgctctatcaccggagcaatagctaccggaatcataaacagtatcggctcccatgagaacttgggaaacacgaactgcggcagcccgatccatgccgcatccctcacaccggacaaatccagatcatagaaaagccatgccgccagataaccgacaatgataccgcaaaagataggaatcaacttcaaaagtcctttcgctttcatcgagacaacgactgccgtaaccagcgacaacaaggccagcacccagttctccttcgccatatttactcctgtccccgcgagtgacaaaccgatcagaataataaccggcccaataaccaccggaggaaacagacgttcaatcaccctcaccccttgccatttgaccaacgcgctcattacaaaataaaccaatgcgacgcccaccattccggacagagtgcccgctaatccgtaaagttctgtcgcttttattatcggagcaataaacgcaaaactacttcctaaaaagataggcactttccctcgggtaaccgcatgaaaaatgagtgtaccaatgccggctgtgaacaaggcggtggaagggtcaagccccactaaaagcggcacgagcaccgtagctccgaaagctacaaacaagaattgtactcctaccactcctttccgtaaaggagtaagattgtttgaatccataagtatgatgtagattaattgagtgcaaaattaatctttttagacaatttaactaccttttttcacaaaaatacatccaaaaagactctttatttgttttaaataatgtgtaacttcgcacggtgagacctattacgacacatttaataacttaataatatattgcctatgatatttacagcagaaaacaccctactaattggttctatcttacttttcgttagcatcgttgtcggaaaaacaggatatcgcttcggagtgcccaccttattactgttcctcgtagtaggaatgttgttcggaagtgacggactcggactccagtttcatgacgcaaaagatgcgcaattcatcggtatggttgctttaagcatcatcctgttttcgggaggtatggatacgaaattcagagaaatcaaacccattttaggtccaggtatcgtgctttctaccgtcggagttctactaaccgctcttttcaccggattatttatctggtggctgtccggaatgagctggacgaatatctatctgcctatcaccacgtcattgctactggcatctaccatgtcctctacggactcggcttcggtgttcgccatcctgcgttcgcagaagatgaatctgaaacacaacctccgccccatgctggagctggaaagtggaagtaacgacccgatggcatacatgctcaccattgtcctgatacagtttatccaatcggcaggtatgggagtcggggctatcgccgcttctttcatcattcagtttatagtcggcgcggctgccggatacgtgctcggaaaactggctatccgtatgctgaacaagctcaacatcgacaatcaggcgttgtatcctatcttgttgctggcgtttgttttcttcaccttctctatcactgatttactgaaaggaaatggttaccttgccgtatatatcgcaggtatcatggtaggaaacaacaagatcatgcaccgcaaagacatttatacgttcatggacggacttacctggttgttccagatcatcatgttcctctgcctcggacttctcgttaatcctcatgaaatgctggaagttgcagcagtagcactattgatcggtgtcttcatgattgtgatcggtcgcccgttaagtgtgttcctctgtttgcttccgttccggaagattacaatgaaatcgcggctgttcgtctcctgggtaggattgcgtggagcagttcccattatcttcgccacttatccggtggttgcaggagtcgaaggatcgaatattatctttaatgtcgtattcttcatcacaatcgtttcactggtagtgcagggaacaacggtttctttcgttgcccgcctgttacatctgtccaaaccgctggaaaagacggggaatgatttcggagtggaacttccggaagagattgatacagacctcaaagatatgactatcacacaggaaatgctggaagaggcagatacgctgaaagatatgaatctccccaaaggcacgctggtaatgattgtgaaacgtggggatgagttcctgataccgaacggaacgctgaaactgcatgtgaacgataaattgctgctcatctccgaaaagcccaaagaggacgaggaagccaacagcgaatcctgatgtttatagggactgactaaaaagtcaatagtatctccaattcccctcctttcggaaaggagaggtggctgaaagccggggtggtaggtaaaataaggtttattcctattctattgtaaacaacagagttatgtgttcacctaccacctccccctacggggactcctccttcccgaaggaggagagttaagatactaccaactttttagtcagccccatttaaggtactaccgactttttagtcagcttttcctcccccgttaattaaccgtaaaacttaattgtaaacttcggtttccgttaatgaaatgttatttttgcgcaattttaaatcaaatgtgcaaaaatcgaatggaacaagaacatcagttcattgattatattgaacagagcatcattgaaaactgggataaagatgcattgacagactacaaaggaatcacgcttcaatataaggatgtagcgcgcaagatagccaagtttcacattgtattggaaagtgccggtatccagccaggagataaaatagcagtctgcggccggaacagtgcccattggggagtcaccttcttagccactatcacttacggagccgtcatcgttcctattctgcatgagttcaaagcggataatattcataatatcgtcaatcactccgaagccaaattactctttgtcggcgatcaggcatgggaaaatctgaatgaagacgcaatgccgctactggaaggtatcgcttcactcaccgatttcactgcattggtatcgcgcaacgagaaactgacttacgccttcgaacaccggaacgctatttacggtcagcgttatccgaagaatttccgccccgaacatatctgttaccggaaggaccgtccggaagaactggctatcatcaattatacctccggcactaccggatattccaaaggagtcatgctcccctaccgcagtatttggtcgaacgtgacatactgtttcgagatgcttcccgtgaaagcgggcgatcacatcgtttccatgcttccgatgggtcatgtattcggcatggtatacgatttcttatatggtttctctgccggagcgcacatttacttcctgacacgtatgccgtctccgaagattattgcgcagtcttttgcagaaataaagccaagagtgatctcctgtgtacctttgatcgtagagaaaattatcaaaaaagatattcttccgagagtggacagcaaaatcggtaaactattgcttaaagtgcccattgtaaacgataaaatcaaatcgttggcgcggcaggctgctatggaaatcttcggtgggaacttcgatgaaatcattatcggcggtgctcctttcaatgccgaagtagaagcgttcctcaaaaagataggctttccctacaccatcgcttacggtatgaccgaatgtggcccgattatttgctccagccgttgggaaacactgaaactggcttcctgcggcaaggcaaccacccgaatggaagtccgcatcgactcgcccgaccctaaaacacatgccggagaaatcgtatgcaggggaatgaatatgatgctgggatattataaaaatccggaagcgacggcacaaattattgatgccaacggatggcttcacacgggtgatttagggacaatcgacgacgaaggatatgtgacagttcgcggtcgtagcaagaatctgcttctgacttccagcggacagaatatctatccggaagagatagaaagcaaactgaataatatgccttatgttgccgagtcactgatcgttttgcagcacgacaagttggtcgcactgatttatccggactttgacgatgcttttgcccatggcttgcaacaggccgatatcataaaagttatggaagccaatcgtgttgaactgaatcagcagcttcccaattattctcagataagcaaagtcaaaatccatttcgaggaatttgaaaagactgcgaagaaatcaatcaaacgctttatgtatcaggaagcaaaaggataacacatcctttcaaaaccatactcaataaaaacaaaaacggtgaacaggtatcaaaaccctgtccaccgttttttcagtctaacctaaccaacttaattttatcttgtcatcctccgacaatctctctactttaacaacctcacttattaccctcacctattacttattacctattacctattacttactacctattactttttataaacgaaacagcctgcccgcctccgggagccatccgtatactcaacgtattttcagatgttacaatctgttccgtaatcttataatcggtaggattcgttttccagtcagccttttcgccatccgcatagatgacagccttatactgcttgcctggttccaggaagtccagttttacttctaaagtacgggggctttcattggtagctgctcccaggaaataattgccttttgctttacgtaccactgcaatgaactctcccggttcacctgccagtgctttcgattcatcacaatccggatcaaaatcacggaagaactggaatgccggatgtccttcataatgctcgatcatatccgaagccatctgcaaaggagaatacaggattacccaattagccagttgtttagccagcgtcgtattcacacggctattgcctttatcctgatcgttccacttctgtcggcgcggagaatccttcgttttcaagaacagaatatcaaaagttcccggcgtataatccatcggaccggacagcaggcgggtgaacggtaacatcacgtgatgagaaggaggattgccttcactccacgcattccattccatgcctcttgccccctcgcgtgtcatcatattcggccatgtacgacggataccggtatctttgatcggttcgtgtgcatccagagtcatttgatgacgggcggcagtttccactacccgttgatagtgattgacaccgtattggctatgatgcagatatccgtccggaaatgcgcctgcatatcccgtcttcaggaggtggataccatgatcggtataccattgcatggcatgatccatctgacgttcatagttaggaatattccctccggtctcatgatgtcccatgatttcaacacctttctctttggcataacgtacgatttcatcaatattgaaatccgcgtatggcttagtgaaatcaaagctctgcataccgccccaactttcccaaccttcgttccaaccttcgaacaggacagcttcgatatgattggctgcggcaaaatctatgtatttctttgcattggcagtagtagctccgtgacgttcgtccatcttccaggtttctacgccgagatgcatcccccaccacactcctacatatttcagcgggcgaatccagtccgtagtttccagtacgcaaggatcattcagattcagaatcagcgaagagttgatcaaaccgacagcttccggtgcgatctgtacggtgcgccatgaggtcgtgaagtgatttcccttacgcgccttaatgccgtcaggccacggggcaagttccgctttcaatgtataatgaccgatttgcttcagagtcatttccgggaaatcatacaaagcggcttcgtgtatacttccgtaaactccatccgcagtcttgaatgtaaaaggtgtattggccgtttccacttcggaaatcggttgttgttgatagagtagttcatatgtttcggcactggcgggaatcgaccacgaagttccgtcacgatggaaacggaaagtagtcagttcgtcggttatcaataaagaatctacagtcggtaccgtatattcatagcggaaaccgattccatcatcaaatacacgaaaacgaagcgtcagttgtacatgatcttcatttgtcagattgactgccatttcgttataatgattccggttctttttattctctccccacggctgtgtccaagtttcgtcttcactgctgaaagtcgtgttcttcacctgaaaaccttctcccagaatgatgccgttagccgccgtaaagcccatggctgaattttctatcaagagggagtcatccaccgacacattataaaacggtttgccgttttcgtctaccgtcaatgtcatcttgatatgtccgtccggtgactggacctctgttttcgggctactacaagcatagcatcccagcacacacagaaaagctccaactaaatgttttactttcatagtataatcgtctgtttatatataatacagttcagaaaggagaaacacttaaatgtatgccgtttttctttcttcggatacaaagaaaaagtatctttgcatataaacaatgtagatttatggccaagatactattagcagaagatgaagtcaatatcgcctcctttattgaacggggactgaaagagttcagacattcggtaacagtctgtcatgacggaaatacgggttggagaatccttcaggaagaacctttcgaccttgtaattctggatattatcatgccgaaaataaacgggctcgaactttgccatctctatcggcagatgttcggttaccagacaccggtcattatgctgacggctttaggcactaccgaagacattgtaaaaggactggatgcaggagcagacgattatctcgtcaagcctttcagttttcaggaactggaagcacgtatcaaggcgctgctgcgacgaaacaaggaggctgtaaccaatcaactgacttgcgacaatttggtattggactgtaacaccagacgggcaaaaagaggtgatgcggatatcgatctcaccgtaaaagaataccgcctgctcgaatatttcatgactcaccagggggtagccttgtcacgcattacgctgctcaaagacgtatgggacaagaactttgatacaaataccaacatcgtagacgtatacgtcaattatctacgggtaaagatagaccgtgacttcgacaagaaactgattcatacggtagtaggattaggatatatcatgaatgcctgaacatccatcaaataaatccgtgtatgaaaataggttctaaaatagctctcttctatacgttgctcagtgtactgacaactatcatcattattgccgtattctatcttttcagcacacagtttatcaataaactctatgcctcctaccttcgtgaaaaagcatatctgaccgcacaaaagcactgggagaaagacgaagtagacgaacagagttaccagattatccagcgcaaatatgacgaactcctgcccgaagctcatgagattcttttaaatatggacagtctctccgaagtccgtgacactctgaacaaatatctgacccagcatcagcaggcactcctgatagccggtgaagacagcatccctttttcttttaaatacaaagaccagttgggagccgccctttattatcccgataatgaagggaatttcatcgtcctcgtcatgtcccggaatgtgtacggtgcagaaatcaaagaacacctcttgcttctctccatctttctggttttattcagttccatcctgatttatttagtcgggaaaatctattccggccgtattcttatccccctgcagcatatactgaaggagctgaagaggatacgagccaacagtctgaaccgccggttaaagacgaccggaaacaacgatgaactggaagacatgatcaaaacactgaatagcatgctcgaccgtctggacagtgctttcaaagctgaaaagtcctttgtcagccatgcttcgcatgaactgaacaaccccataaccgccatacagggagaatgcgaaatcagtctgctgaaagaaagaagtaccggagaatatatcgaagccctgcaacgaatctcatccgaaagcaagcgaatctccaatctgatccgccatcttcttttcctttcacgtcaggatgaagagctcttaaaaagcaatatggaggcagtgtctctgccggatatgctggatgacttaataaaaacgaacgaacgaatccggttccatcatgaagaaacaggtaaggctgccactgtaaaggccaatccttatctgctcaaaatagctttaaagaatatcatcgataacgcctgcaaatattcagaaaaggaagtagacattacgctcagccggaaagatcaacacctcgttcttgaaataaaagatcagggcatcggcattcctccggaagaaatagaacatatattccagtctttctatcggggcagcaacacacatgactatgcaggtcagggcatcggcctcagcctgactctgaaaatagtatctgtctacaacgccaggctggagatatcttcggaaatagaaaaaggaacaaaagtacgggtgatcttctgattcaaccgacttttgtcccttcctcacttctacctactgaaaacgaaattaaaatttaatctatgccgtttctttcatagaaagaatagaaaatgaattagatacgtctttgcaataattttccgtttttatcatatagcattcgttcatacactacttccacaatcagcgggaagatgaacagggcgaagaaagtcgctcctatcaatccgccgataatgacaatcgccagcggacgctgtgattccgaaccgataccatgactcatagccgcaggcaacagaccgatagctgccatagccgccgtcattatcacagggcggatacgtgatcggactccttctttagtggcctcctgtaaaggcgaacccagtttcagatttgccttgatatcggaaatcataataactccattctgtatgcagataccgaacaaggcgataaaaccgatacccgccgatatagagaaattgaagcccgttatcagaagggctgcgatacctcccacggcagcaaacggtacattcagcaataccagtcctgcatctcttgcattggagaagagaataaacagaataataaaaataatggcaatgctgataggtactacctgtgccagacgtttcgaagcacgctgctgattctcaaaatcacccgtccatttcaaagaatatccagccggtaaatggacggaagcatttacctttttctgcgcttcggcaactgccgtacccatatcccgtcctctcaccgagaacttgacagcacagaaacgagcatggttgtcacggaagatcaataatggtcctgtaatcgtagtgatatctgccagttccttaataggcaccatcgttccgtccatcgccggaaccagtatcttacctatctcctcttcattctgacggaactcttcactatacctcaccatgatattaaatttccgttcgtcctcatacaacagcgaagctgacttcccgccaatagccatttcaatgatagactgaacatcttccttagccactccataacgtgccaactgacgttcgttcagttcaatacgaagttccggctggccgatattgcgaatcactcccaagtcttcaattccctgcacggtatttaagatcttatcaatctggacggccagtttttccgattcgtacaaatccttaccgaacactttcaccgcaatagaaccttttacaccggaagccgcttcttccacattatccgtaatcggctgcgaaaagttaaagtcaatgccgggataaatggataaatcttcctgcatcttgtcgataagctgcagtttggtcagtttgctttcccagtctttctccggataaatatctacgtgaaactcaatattataaaatccggttgcatccgttccgtcgttgggacgtccggtttgagacagtacctgcctcacttcggggaaagtcaatagtttctttctcatcttatttgccagcgttacggattcatccagcgatatactttgcggcagcgtagcacggatgtagatcgaaccttcgttgagctgaggaagaaactccgtcccgaggaaagagaaaagccataaaccgactcctgcaactacggttgccagtccgatagtcagcttgcgatgagcatagaaggtatcaaaaagagccgtgcacttttgattgatgaaatggacaaagcggttgttcttttcgcgtacattctttttcagcaacatggacgacatgacgggaaccagcgttaatgtgaaaataagcgcacccagcaaagcaaaacccaatgtatatgccaaaggtgagaacatttttccttccactttctgaaaagagaaaataggaattaaggcagtaatgatgatcagtttggagaaaaataccgcttttgccttatccttggcggtatgacggatcagtcccatcttggacatcacattgaatgcgggcattcccacctctttcgccttcttgtccaaagcgacaaacacaccttccaccatcaccactgccccatcgataataataccaaagtcaatggcccccatagaaagcagattggcagacatccccatcacgcgtaaacaaataaatgcgaataacaaagctaatggaataatcaccgcaacaatcacggttgtccgccaatctgccatgaagattaacacaataaacgtaaccaacaatattccttcaatcagattatgggtcaccgtttttaccgccaggttcaccaagtcctcacggtcgtagaacggtattatccgtacatcttcaggaagtacattctgattcaattcttctatcttatctttcagatttgcaatgacttcaccggggttctcccctttacgcatcaccacaattccctgaacgacatcgttctcatccattcgtcccacttgtccgaggcggggcaggcaggattcgtgaacatctgccaggttctttacgagaatcggcgtcccgttgatgttcttcactacgatgtttcgcaattcatccaggtcgtttatcaaaccgattccccggactacgtatgcctgagaacttttcgtgatgacatctcctcctacattgatattactcttggctatcgcgtcataaagttcgagagaggtaattccgtaattaatcaactgatgaggattcacgctcacttcgaatgtcttcacctcgccaccgaaactgacgatatcagctacacctgataccgaacggagatttcgttcgatcacccagtcctgaatcgttttcaaatcgcgtacactacgtctgtcactgcgcagggtgtagcgatagatttctccggtaggtccgtacaaaggctgtacttcgggagtcacgccttcgggaagatcggcatcattcagcaaattgtagacttgctgacgggctgtaaagtcatcaacacgatcttcgaacattacattgatcacagaaagtccgaaaagagtggtcgaacgaatatccgtttttttctgtacgggattcatggctatctcaatgggaatcgtgataaatttctccacctcttccgcactacggcccgcccattgcgtgatgatcgtcacttttgtattcgttacatccggaaaggcatctatcggcgtatgtttgaatgagacggctccggctataacggcaatcaccgtacagaagaatataaagaacttattcttcagcgagaaggctactatattatctatgaatttatgcatactattctctgatttttaatccgcattcaaagcattatacactaacaatacattattattcagtaccctgtctccttcggaaagaccggaacggacataacattccttgctcaactgtttgtaaacgtctacttcctttatcttcagacgctggtcaggctctactgtgaccacataattctttcctccctcgaacaccagcgcatgggagtcgatacgaggcatggaagtatcttccgctttacacttcacgctcacgtttgtaaacatacccggcttcagcaagtaatcctcgtttttcagtttgatgcgtacgttcattgtcttactttcactgtccaacaggtgataggccttgtcgatcgtacctgtaaatgtcctttccggatatgccaaagtcgagatacggacatcagctccctcggaaaccttactaatatcactttcatacacatccgccatcacccatacatcggacagaccggaaatcgtaaacagcgcatccccctggtcggggcgcagctgcatatccctgctaatctgcttttccacaataaagcctgatacgggagatttgagctgataaaaagcatttccggagaagtgataaatggagaatatttctttgattcgtctttcttccgcttccgcagttgccagttcctgcttggcctgaagtacatctttatccgatgccatgccggaagtgtacatatcctgtgtggcatccatgttccgccgggccagcaagagttgttgttcagcttctttcaattgtttctcataatccgccacttccccgctacggatcactgccagcacttctcctttgtgaacaaagtctcctatttcggcacgcagttccgtcacggttcctccgaacatcggatacacatttgccacctgatcctgattgaaagtgacccgtccattcaatgtcagttcatctaccacttcacagacgtgcacggtatcgacggatacgattctcagcaggctgtccgtcaggcatagtgtagtcggttctactttgggttgttctccttttccggagcatgctcccaaaaggctgccaaacaatatacaaggaagaaatttattccagttcatagtctttgataatttatggattgtgatctttaatcgtttcatattggtcggtttattagtagttcaatacattttgtccgacaactgtattcaggttttccatagcgagaaatacgtttttctttatctcgtatagttggatacaggtttctttatagctgtcataatagtcgataaattccagcaggctgatattctttctggtgaaattctcattgactcctgtgatcaatttctcgaagttacgttccaggtccatattagtggattgatagagttgagtcgctttctccagagacgtataagcggtgaagagttccatatcggcacgattggcagcatattcctgctgcactcccgcctgctggatactgaagcgggctgctttgatatttccctgattacggttgaagataggtacggacaggcttactcctatcgcgaaatagtcattgataaagtttcctacacggtcataattccctttcacagagaactcgggaaaggccattgacttctgtagtttcagatttgcacgggaggcattcactgtgcttcgggcaatcttttggtcgggccgttcattgatgattgctttcaggtctgcaaatgataattgcgacaggtccagttgttgcagtacttcttcgtctaatgagagttgaacttgtgtatcttccggaaggttcagtaataaattcagttctcccctggtagtcagtaaatcattctcccgttcgttcttctctttcctcaaggagaagagcatggattccagacgggaaatttccattaaagagatgtttcccttttcctgctgaattttcattccgcccaaaagtacttgcagggaatttacttccttttcatagatggcaatggacttagaaagaaagtagacttctacaaacttttcattcaattcctgacggagcgtccgcattacttcttcaaactggtattcagctatttccttattgattttttccagccggacttgcttgttccgctgaccggcaagatggatcacctgttctatttcaacaacagcttccccttcttttccaaaatcaaaatacttcccgttcaatcggttgtagacattctgttccagcgaaatgaccggattttcaaacaatttggcttgtaatacctgcgcctgtgccatgtcgatattgtaccgctcggctatcaacgataaattgcgctctaaaaaacgctgctctgcttctttcagtgtcaatgtgcctgcaacctgttgcgcacacatctttcctgccaatagaagaaatagtaaaaataaaaatgctctgttcatcgcaatctttttgttaccttaatttgttttccgacaaaagtacaactctgcaacggtagaggctggataaaagcgattataaggctctcatttcagattagaatttgattagaaaatatctaaggaaaggaaaaattgtaaacacaacaggaagaatggctatccctctttctctaccatacccctatctttgcaaagtagaaataaataatgaatcattaaaaacaggaaatatgaaaattatagatttaaccaaagaaagctttgttgagaaagttgctgattatcaatcttatccggataattgggaatataaagggaataaaccttgtttagtcgattttcatgctccatggtgtggttattgcaaggcattatcacccatattggaccaattagcagaagaatataaagggagactggacatttataaagtagacgtcgatcaggaagaggaactggaaagtgcattcaagattcggacaattcccaaccttttgctttgcccggtgaatggcaaaccgataatgaaactcggtacaatgaataaggttcaattgaaagagtttatagaaacgactctattttcatgataaaatagaatatagagtactcacattactacttttcttactgaaaaagtccgaatcccaattgctttttgcaatttaaaggttcggactttctattttcagatttaacagatagcacttatcatttatgcagcaatctatcagtccccggaacaacttttcccatcgaccagacacaccgtacattcaattccttatcaagtatcacaatatcagcatctttacctttagacaatgcccctttccgatcgctcacaccaatcagacgggcaggagtttcggaagccatacgcacggcatcttccaaaggaatacttgctttcttcaccatcgtacgaaccaacacatccatagtcgccaaactaccggctaatgcagaatgatccgccatcttacatactccgtcctcaataatataacgcggatcaatcggctcgttcccttcattggcagcataagccaacgcatcagtcaccagacaggtattctcaactcctttcagtttataaaccagtttcagaatagtagcaggcaaatgaataccgtctgcaataacttctaccgtcattccatctgtcaaatatacactttctaccgtaccttcatatttatattcgcgacgtttgtgaaaaccgggcatcgcattatagaaatgagcagcatgcgagaatcctaccgcatacgccgccttaatctcatcatattcagcttccgtatgagtaacggctgtcataattccctttgaacaagtgtattttgcaaaatcatgtgccccatgcaattcgggactgatatcccagcgcttgatgcaagaagtatgctccaacagcggcatatattcattcgcatcgggagttttcagaaaaccgtcatactggcttcctgccatcttcggattcagataaggtccttcgatatgcagaccgagaatcggagactccggttccttcatcagcttctcgcaaacatcgaccgcctgatatatcctctcaaacgaagtagatgacaaagtaggaaatatgccggtagctccatgcttcaaatgagcagttgctgcgatacggaaagcctcctccgttgcttcggtaaaatcatggccgccgccaccatgcgcatgcatactgacaaatcccggtacgattgtcattcctctcgcatcaatcactgttgcaccgataactgccagatcactgttggttacctctaatatttttccatcacaaatcaatacagagccgtctttcagccagccttgcggagtaagtattctaccgttgattatttgagttaacatcgttttcttttttagtcgttaaaacagcttgtttgtaccttctaccaattgtcccatcgcccagaccgctcttacattcagatctctatccaaagcaataatatccgcgtccttgccacgttccaacgtacctttgcggtcgagcactcccatgatacgggccggagtctcggaagccatcctcacagcatccgccaaaggaatttcagcattctgcaccatcgtacggatcagacggtccatcgtcgccacacttcctgccaatgcagagcggtctgccagtttgcacacaccgtcttcgataatgacacgcggatcaaaagcagtcttactgtcacttgccgcacaagccagcgcatcagtgatcaggcacgtacgctccactccttttatcttatagaccagacgaagaatggtaggaggcacatgaatgccatcggccacgacttccactgtcatatcatcaatcaaataaatactttctaccgtaccttcatacttatattccttccgtttgtgaaatccgggcatagcattgtagaaatgtgtagcatgcgtatatcctgcctcatacgcagtctggatatcttcaaattcagcctgtgtatgtcctacagatgccaatacgccttttgcggtgatatactttccgaactgcatagcccccggaagttccggtgccgcatcccaacgtttgatgcaatgggtttcttccagcaaagggatatactcttccggatcaggatttttgatattctccggaatctgtccgcctgccatctccatattgaagtaatgtccttccagatgcaggccgagtacgggactgtccggctctgccatcatcttttcagttgtttctgcggctgcacggatcataggaatagtagaagaagaaagtgtggggaaaatactggtagttccgtgttgcatgtgagctttaatcgctgtccggaaggcgtcttccgtcccctccataaagtctcttccaccaccgccatgaacatgaatttctactcctcccggaacgatatacatgcccttggcatcaatcagttttgctccgataaccgccaggtcgcagttagtcacttccagaattttatgatcacgaataagtacggacccatccttcaaccagccctgaggggtgaggatgcgcgcattaatgatttgtgttaacatatcacaagttcttaaattaattataggtctgtgtgagtcgatgacactctttttgggggaagtacatcgactttcgtaattacaaaaagaggtcgccaatcttatcgactgacaacctcactactttgagcggaaaacgagactcgaactcgcgaccctaaccttggcaaggttatgctctaccaactgagctatttccgcaaactaaattttctccattcagaaatctgaatttcttgtgcccagaacaggactcgaacctgcatgcctctcgacacacgcacctgaaacgtgcgcgtctaccaattccgccgacaagttggttcataacaacttgattataaaccaacttttactcgcactttacataacatattacttgtcataatcaaaattatgagtagcttatcataattttgagggttggcacgacccaaagaccacaccgggctatgtgggctatggtcaccagctacagaagggagagcgtttcccgaaaacactgacacgtcagcgtgcagatttgctgttacggacagacctcctccggcacctgcgcctatatgcccgttatggcagggatgcttatctgcttgccaccctctcgtaccagattggaccagccaagttgttaggcaatggacgatacccgaaagcgtccctgctcacccgattggaacgtggcgacagggacatcctgccactctatctgagctattgcaaatggaggggaaaagcagtggcatccattaggaaacggaggtgggtggaatatcagctgttgtatgccgagcggtgaggcaccatccctcctatacctgtttgtctgtcacttatattatatataaaggtaataattgcaatttcaatgttaaagtcagagcattatggcatccatcaaattaaagttcagaacatcatctgttcaagagaaagagggtcgcctgtattatcaggtgatacacaatcgtgtggcacgtcagatccatacagagtacagaatctattcctcagagtgggatgcggaccattcaaacatcattttgccaacttccgtcactccacaacgtcaagcctatcttctttccttgaaagatacattggatgctgacaggaagaaactgctgttggtcattgcacggttggacaaggaagggcagtcatatacagcagacaccgtcgttgacaacttccatgagggaaaagaattacatggcattatcggctatacgctggagttgaacgaaaaactgagacgcatcggcaagaagcggatggtagcaaggtacaaaaccaccctcaacagcctccagcgttacctgaaaggaggcgatgtgccattggaggaagtcgatgggacaacgatacaaggctatgaacagtggctgaaagacagcggactgtgccgcaacaccacctctttctacatccgcaacctgcgcaccatctacaatcatgccgtagatgacggactggtcatctcttcctcaccgttcaagcatgtatataccggcatcgacaagaccgtcaagcgggcactccccttggaaatcatcaagcaactgaaagagctggacttgagtctgaacccccgtttggagcttgcaagggatatgttcctgttcagtttctatacccgtgggatgtcgttcatcgatatggcacaacttacaccaagcaatctgcatggcagtacgctcatttaccgccgtcagaagacctcacaacagttgcacatcaaatgggaacctgccatgcaggagatagtggcgaagtacaaaacagatgattctccctacctgctccctatagcaaaaggagagggagccatattctggagacagtacaagaatgcctatagccgtatcaccaagcagttgaagaaaatcggagaaatgataggcctgtccgtacccctgaccacctacgtagcccgccactcctgggcaagcatagccaagagcaagaacgtgcccgtatctactatcagcgaggcattggggcatgactccgagaaaaccacacagatatacctctcctcattggacacctctgtcgttgacaacgccaacaatctcatcatcaattctctttaggaggtgcagcgtctcactgcacctttatttcaatatttataactattgtattgcggtgtgataccgcaactataataaacctaaaatccgcaactatcatccaatacacgattaagggtagatttatgagtcgttagtagcagctttcagtaaaaagcaacagcacaacatcaatatgtagccaccatccccttaccccacgatgcgacttgaggtaatacgcagattcaaaccggaaagaaaggattcttatccgaattctgttttgaagggttttgcataagctcggttctctgtgtagatattcagcacgtattgccttgcagtcatgatccacttggcaggtacggagatgaatctgaagacaaaagcctttatgcgactcgttttcttgagcccaaaagccttggtgtcaagcctgctcatgatggtcttgtagaaattgtgtatcaatgcagtaagcagaagaaagacagtattctccgccatgaatgacttggggagcctgctccaaccgaatccgttgttcatgtcgtcaaagatacgttccttgccgccacgcagattgtagaattcaacaatgtcccttgtcgatgacttgtaatcgttggtcagaatacaacggtaagtgtattcgccttcccacaggtcaaggtcgccactgttgcgtctttgtctctggatgacaagacgatagcacttgccttcccatttctcaacgagaatggaattgagttcgaactggatgccgttaatctcctccgtcttccatcctctcagagcaaagatgtcattgtagagcgaactgcatcggttggcacggatgtagaaatgtttgcaatgcttctctatctcactgacgatttccttcgagcaggaaccgcagtctgccctgaagcgatttacacggatgttctgggattccagaagagcgaagaatctcttatgggtgtctgcctgatgaaaacgcacattcgtgttaccatcgctgttctcgatatagactatcttgtcaccgataacatatacgccaggcctgtagccgaggaactttttgtaggtcggttttgcatcatacttctccgtttcaaggaactgatggtcaaagtcaacatcgtattcctcaatttccttcaactcgcctgtagaaaccaaagcgtttataagcaatgtgttgagtttgtctgcagtattgaaatcataggtcttgccttggtcggaagtataggagatgttttcctgtgtcagttccttgatggctctgaggatggtatcagagctgcatgtacgaagggtaggatgatacgagagatggcgcatcagttgtgacgttacatcttccacgcatgagccgccacagaaataaacgctcatcagcgaacggactatctcgctgaactgatatccgaagatactgctgcatctctgacccagtgttgagtcgataacgggtgaaagcatggagtcaaatttctccatgattgaaaaaattcctccaaaaggtgtgagtttttcgaattttatttggcgcctttgcagcgccttgttacgattttcgcttgttttctaattgcaacactaagataagtgaaaaatctgacacggcaaaatcctaggcaacttattgttgctcaggaacttataaataaagttaaattatagtgttgcggaattaagggtgttaaaatatacgctgatacaaataagaatttaggagataatataaatggaaaaatacaacaattggaaacttaagttttatacaatatgggcagggcaggcagtatcattaatcactagtgccatcctgcaaatggcgattattttttaccttacagaaaaaacaggatctgcgatggtcttgtctatggcttcacttgtaggttttttaccctatgcggtctttggaccagccattggtgtattagtggatcgtcatgataggaagaagataatgattggtgctgatttaattatcgcagcagctggggccgtgctagctattgttgcattctatatggagctacctgtctggatggttatgatagtattgtttatccgtagcattggaacagcttttcataccccagcactcaattcggttacaccacttttagtaccagaagagcagctaacgaaatgcgcaggctatagtcagtctttgcagtctataagctatattgttagtccggcagttgcagcactcttatactccgtttgggatttaaatgctattattgccatcgacgtattgggtgctgtgattgcatctattacggtagcaattgtacgtatacctaagctgggtgatcgagtgcaaagtttggaaccaaatttcataagagaaatgaaagaaggaatggctgtactacggcaaaataaaggattatttgctttattactcgttggaacattatatatgtttgtttatatgcccataaatgctttatatcctttaatcactatggaatgttttaatggtacaccgatgcatatttctattacggagattgcttatgcctctggtatgttgatagggggtctattattagggttatttgggaattaccaaaagcgaatcttattaataacggcatccatttttatgatggggataagcttaaccatttcaggattacttccccaaagtggatttttcatatttgtagtctgctgtgcaataatggggctttcggttccgttttacagcggtgtgcaaacagctctttttcaggagaaaattaagcctgaatatttaggacgtgtattttctttgaccggaagtatcatgtcacttgctatgccaattgggttaattctatctgggttctttgctgatagaatcggtgtaaatcattggtttttactatcaggtgttttaattattggcattgccatagcttgccccatgataactgaggttagaaaattagatttaaaacaaaattcataggagggaccatatttatgtatttaattttcatgtaattcttcctgctaaaatcgcagggttttccctgcgtacaagcaaaagaaaacatgcgattatagacaggaggaaatgttatggaattgatattaaaagcaaaagatattcgtgtggaattcaaaggacgcgatgttttagatataaatgaattagaagtatatgattatgaccgtattggtttagtaggagcaaatggtgctggaaaaagcactttactcagggtacttttaggagaattaactcccccaggatgtaaaatgaatcgtctgggtgaacttgcctatattccccagttggacgaagtaactttgcaggtggaaaaagattttgcacttgtaggcaagctcggtgttgagcaattagatatacagaccatgagcggtggtgaagaaacaaggcttaaaatagcacaggccttatcggcacaggttcatggtattttagcggatgaacctacgagccatttagaccgtgaaggaattgattttctaattggacagctaaaatattttacaggtgcactgttagttattagccatgaccgctattttcttgatgaaatagtagataaaatatgggaactgaaagatggcaaaatcactgagtattggggaaactattctgattatcttcgtcagaaagaggaagaacgcaagagccaagctgcagaatacgaacaatttattgcggaacgtgcccgattggaaagggctgcggaggaaaagcgaaaacaggctcgtaaaatagaacagaaggcgaaaggtgcttcaaagaaaaaaagtactgaaggcggagggcgtttagctcatcaaaaatcaataggaagtaaggaaaaaaagatgcataatgccgctaaatccctagagcacaggattgcagccttaggaaatgtagaagctccggaagacattcgcagaattcgtttcaggcaaagtaaagcattggagctccataatccataccctatagtcggtacggaaattaataaaatatttggggataaggcactgtttgaaaatgcatcttttcaaattcctctaggagcaaaagtggcgttaactggtggtaatggaaccggaaaaacaactttaatccaaatgatcttaaaccatgaagaaggaatttctatttcacctaaggcaaaaataggttactttgcacagaatggttacaagtacaacagtaatcagaatgtcatggagtttatgcaggaggattgtgattacaatatatcagaaattcgttcagtgctagcatctatggggttcaaacagaacgatattggaaaaagcttatctgttttaagcggtggagaaattataaaattgttgctagctaaaatgctcatgggtagatataacatcctactaatggatgaacccagtaacttccttgacataccaagtttagaggctttggaaatactaatgaaggagtatgccggaactatcgtgtttatcacccacgataaacgcttactcgaaaatgtagctgatgtagtttatgaaattagagataagaaaataaatctgaaacattaaatttaaggtagtcgctgatcagtatagtctgttctggctggcggctccattgttaaaaagtataaagacttttttctaaaaatattattcgttgagaatgagattggagggtttatattgtttatacgagtagttccgtacgaccccttttgggaagtagagtatgaaaatgaatcacagaagataaagaatatattgaaggatatattggtggaggtttaccatattggcagtacagcagtcaaagggttagccgctaaatcaatcattgatataatgcccgtagtgacaaatattagtttggttgataagcataacaaagaatttgtagcgattggttatgagtgtatgggtgagtttggtattgaaggacgtagatatttccgcaaaggcggcgataacaggacacaccagattcatatttttgagcaaagcaatcacaaagatattaataggcatatagcagtaagggactttctgcgtacacatccagacatcgctttagagtatggtgaattaaagatggagctggcttatcgattctcggaggatattgaaggctactgcactggtaaggatgcatttgtaaagcaactagaaaaggatgctttgctatggtatcaaaataatgaatcatataaaacacgatagaaaatatataaaagtatgaaagagaggtgtatcctatgataggaccagataagaaaaaactatggcagttatataccacccgaccctaagccgggtgggtataacttatgtttataattagaccgctaagatagcgattatttctaaaatatcatagagaaatatcacttatcttccaagtttaataagagcaccggatagcaagcatccaatgaatcctatgatgattattaatgccataatactaattttggatattgattttatttaacatactatttcttgcgggctttcatgttaatgctgctctcatccatttgcatggaaagttccgctgtgttagaggttaaggacttaattgtataacgagcatattcctcgccatctatataggtggtgatattcttaccttcggcaacatacgttccacctccatctcctaaatagcctgagccataataagtcccatcagaattaaatcgcatagacatggcaaacttgtcataaggatatttggttacatcgtaccaagttccaccagccatgatttccgtaacttcccatgttccgtacagtgtgtccataggataatcaaacttagattcatcatcatctgagcaagacgagaaactaactactgctgcaaataccagcatccacattaaaaaaatcttcttcataccatttttgtttttaattggttaatactaaagtttaaaaaaagctctctctcatttagcaataaccacacatcaaggtacaaaaaaagacgtagtgctactgccatacgtcgtcaaggctcaccacaagcccacttactcaatggcagcgcactacgccaatatgacgaagtacacttaacccaatgagtaagttcattaatagccttagtgttatccgaggtggtgattctgacgacgattaggctactttattattgaacagttggatttctccccaacttttcgtatctttagtgcaaagatagtataaatcttgcagtttaaactttgaaacttcaaaaaattgctaagaataaatacctcattcaatttaattgatttaatttgcaaaaaaaagacaaatatgaaagctttagatgtatcccattatataattgccaaatatgataatgtaggtgatttgataacaaataagaaattgcaaaaaattctctattatataaaagcatggggggtggttttctttaaagaaggagttattgatgatgaatttaaggcatggatacatggtcccgtttgtcctgctgtatatcaagaatacaaaagatttggatataacaatataagtcttgattatcaaggattatcttcctctcagtttatcaatcaatttattaccaaatatggtaaaacagaagaagatagaaataaaattgctatgattgatgctgtttttaataaatatggaaatttatcatccttacagcttgaacttcttacgcattccgagtttccatggattgaagcaagggagggactatctccagtagaaactggaaataaaaaaataagtgaagaaactatgcgaaaattctatggcgcaaaagacagatgaatacattcgctaaattgaaggagtgggaaatttctataagtgaagctcactcaaaatatgaaataggaaaaggtactgatgcctttgaagatattaaggatttaaaacctgtcttttcttttgattatgtttccatgaggaatggttttttttgcttcaatggaaaaactcttgggagaaaagattatataaaactgataaaagcattaaaagatgtatcgctatacacttatgaaacaatgaataaagaacaacgtttccattttcacaacataaattggaatgatgttactatatcagaatcagatttttacaagtgtatttatgaagaataccatggagaaaaagatataactccatatcaatttaaagtatatggagaagccagaattataggttttttgtaccgtggagttttctatttggtaatgtttgatagaggacatagagcttataaaagaaaatagtaatctcattaagaatgtttatttccttttgactgctctcttaacaagttactcataagcctatcaagttcttctcttgaaacttgcaggaacggattaggattgaaacctttctttggtctaatcttttttctgatttccacattttttttcttatgtgccatagttatgcaacgttgcgcaaatataagtctattctttgaaagttcgtataaaaccgagtgttaaatctgaaaacatattcgtcaatatatcgctggaggtgctttttactaactgagtaatatgttccgattatcattcttttaaagtgcgaccaagcattttcaataccatttgtacttacttgtatgacttctcccttatctgtcgcataagtagagccatagtaatgtttctcatggtctactgacctttgaatgtagtcattggttattcctccatagtcccagccgtcagtatatatgacgcttccggatttaacatagccttttatcagagggagcagtgtccttactttggtatcgggcactacctttgctactaaatgaccgtttctttccagcattccgaataccggaactttatccttgaaagaacgaccttgacatttctcaactttcttatcttcatgccgattcttgttcttgcccccaacaaaggtttcgtcaatttctacctcattgtcaagagtatgctcattttcaaaacttgtatagaatctaagtttatggagcatataccacgcagttttctgtgtaactcccaaatctctcgccaactggcaagaagaaacgccccgcttgtgagatagaaacatgaatatcgcataaagccaatatctgaacggcaattttgtgttggcaaacggtgttcccgttttcacgtcgaagtatctaccagtgttcttacacttgtactttccattgctacatttgtagactttggaagaagggtcgaacggagatacaactttgccgttccacctcatttcttcaaagtatctaatgcaactctcctcatctgggaaagattctgtgaatagtatgaaaccgttcctcttttccatagtgattgcttttaagacttctacaatatagtaaaaattcccgatatatgcaaataaatagctatatattttcaagctatctaaataatggctatatttgtatcataatacgaatttcaaagaacgacatttagttttggaattataaccaaaagttatgaaaaagaatcaagtgttactttgtatataagtgccaaaactatatccaaatgaaaacataaaaactgtttgttaatgaaataaattaaggaggggttataatgaacaaagtaaatataaaagatagtcaaaattttattacttcaaaatatcacatagaaaaaataatgaattgcataagtttagatgaaaaagataacatctttgaaataggtgcagggaaaggtcattttactgctgaattggtaaagagatgtaattttgttacggcgatagaaattgattctaaattatgtgaggtaactcgtaataagctcttaaattatcctaactatcaaatagtaaatgatgatatactaaaatttacatttcctagccacaatccatataaaatatttggcagcataccttacaacataagcacaaatataattcgaaaaattgtttttgaaagttcagccacaataagttatttaatagtagaatatggttttgctaaaatgttattagatacaaacagatcactagcattgctgttaatggcagaggtagatatttctatattagcaaaaattcccaggtattatttccatccaaaacctaaagtggatagcgcattaattgtattaaaaagaaagccagcaaaaatggcatttaaagagagaaaaaaatatgaaacttttgtaatgaaatgggttaacaaagagtatgaaaaactgtttacaaaaaatcaatttaataaagctttaaaatatgcgagaatatatgatataaacaatattagtttcgaacaatttgtatcgctatttaatagttataaaatatttaacggctaaaaacaataggccacatgcaactgtaaatgtttagttataggtagggtagcattagttaaaatgctattctgccttttaaaagtatggtatacattcctgagagagattggatatgttcccgtataccgatagtgccaaaagcgaagtggatatgtttccgagaacggacgtactcaaatgacattcattctgtcctctccagccacgtggaaagtttagtttgtctgacgaagcagacaaactaaagcgatataaatcctcacggatttgcgatatacgctacatttcattcgcgtgcgatatgcctctggcgcgatatgtgccttcggcacgtgagcgcactgcgtgcgcataggggcgcgggaatttatgttcgcgtactttccaccacgttcgaataggcgaaaagaaagctataaaactgcttgaaactttttaatataaacctgaaaaatacgccaaagggttaatcatatttttgaattactcggtctttcactttttgaatgctatgatatgaccgggaagccttataaagaagtgaagaaaattgcaacggagataaataactttttaaacaaggggaattcagatgaaagaaaacaaatatgatgataatatattttttcaaaaatacagtcaaatgagtcgctcacagcagggactagccggtgcaggagaatgggaaacattgagaaagctgctgccggattttaaagataagcgtgtgcttgatttaggatgcggctatggatggcactgtatttatgcgatggaacacggtgcttcttctgttgtaggtgttgatatttctcataaaatgctcgaggtagccaaagaaaaaacacattttccacaggttgaatataaatgctgtgctatagaagatgtggaattcccagaggagagttttgatgtaatattaagttcacttgcgtttcactatgtagcagattatgagattttagtaaaaaagatatatagaatactgaagtctggtggtaagctagtttttacggttgaacatcctgtttttactgcctatggaacacaagactggcattataacgaaaaaggagaaatactgcattttccagtggataattattattatgagggcaaacggacagctgtatttttgggagaaaaggttacaaaatatcatagaacactgaccacatatctaaatacgctgctttcaaatggttttataataaatcagattgtggagccacagccgccggaaaacatgatggatattccggggatgcaggatgaaatgcgccgtcccatgatgctgattgtatcggcgaacaaaaaagtggatagatagaactaaaacacctataaggtataaatggaggtaatttatgtttaaagaaaaaattattatagagatgaaagaagtattcaaagaaattccttttggcatagagcatactcttaaagttttgaaaaatgcagaagatataatgaacggagaaaatatcggagaggaagaaaaagaattcatcagtattattgctatactacatgatattggtgcggttgaagcacaaaaaaaatacggttctattgatggtgtctatcaagaaaaggaaggaccagcagtagcgaaagaaatattaaaaaaggtaggctataacaaaaatattgatagaatatgctttataataggcaaccatcatactccatctaaaattgatggacttgattttcaaatacaatgggaagctgatttgcttgaaaatttaacggttatggataaagaaaaagaacaggaaaagataaaaaagtgtataggtgaaaactttaaaacaaacacagggaaaaggatagcttataatcgctttattttagattagtagtagattattacagttatgtattttactcaagtttcggatttaggttttatgcagtctgagcgatcagttgcatggccttgaacctgcggttatcccgtataatttgctccatcaattcgttctcgtcaatggtaaaaatctcagccacgattgctattacatcaataatgattgaccagatcttttccacgacggtgagctcgtgtacgccttcatatatatcggcgaacaatcctccaatggtctcttcaccatgctcttcaggcgctcaagcttggatacgaaatactcttccttgcgtttttcggtctggcagtctctgtcacgcttgcggttgtagcgcctctcgcgctgccgggccgtaagaccttgttccttgccatcgaccttccctctctcgccgtgaatcgagaagtccacgacaaattgagagcggccgtcgctccagcacagggccagcagcttgtagccgagaatgcaccgctgaaacacgtgcgagaatatcttgccaatacactccatcctcaatccggtcttcggcaggtcggaatcatccacaataagcactgccggaagatggctcttttgatagtctttccttatggtcacggccttgatgagatgacaggcgatgtgccagatgatgttgctagtctatattgtccttggccataaacgaatagagtaggtccttcttacccccgaacagtttcgagattgacgatccggcataatgagaaaaacccgggacggccataaacggcagaatcaatatgatctggaaaagttgaaggttggtaagctgacagttctcacgttttttccctccgagatctttgtctgaaatcctcatcccctcaaggagggtcataaacttggaaaatgcgggattgattcgttttcccgtgaaaaagttgcggatctccgatggaatttttgtaattttgctcatggctttgagtgattgtaattagttgtttgggcacctctaaattactaaatttccgtgacatacggaaatcctcaaagccttttttatgcccaaatctatcctctcaacctaaatccgaaacttgagtaaattataattatgagatgctacgtgcttttgttcaatataccctaaacgtcgatttaaatgcgcctgtgataaaggatttagttgaaaagtataaggatatagaacaatttaataggagcataacagataaatacgttgcaatatgtaaacgcttttaatatttgaatttagccgtttatgtagaatgaaggtgtgcaaacaaacagaccctgaaaagggtctcacccccgttaaccgcaatgtcaaagacttgcggatggccagatgactcctatacatccgaccccaacggggtcgaaccatataatctgtagaaaggttcgacctccgttggggtcgtggattgggaaggcacttcgacccgcacattgtatcatgtgcggttacttgaagttcgactcccgttggggtcgatggctcgtcgttattctgaatcttagcaaatcctctcttttttaatgaactgtgtgcttgatcactgaaaataatccttatttttgccacgagagttttacgaaagataaatagataaagtattggaaaagaaacataactgtcagcagtgcccactgaggcggcgatacgaccgttcacccaagtcattgttgggtcgtttttggcgatggcacatcaatttctgtccgggatggaaagcctatttcctgtcgctgagcgaagaggaacggcatgtattgagaaagcaatacgcttttcataagcctcaaatccgcaactaagtccttcatcgtcctatttacgtgtacacgttctctcattactgaattattagataaattgaggctgaaatacccacttctgcctacaatacccccttaccccacaatgcgacttgagacaatacgcagtatcatacccataagttgtagtcgtcatccaaaatcagtctggaatacatctgcgtaagcattattacaggtatagatattcagcacataccaccttgatgttctgatccatttggctggtacagagacaaatctgaagacaaacgcttttatgcgacttgttttattgggtccgaacctctttacgtcaagtctttggataatgaccttgtagaagttacggataagtgctgtaagaagaaggaacactgtgttctctgccatgaaggatttgggcaatctggaccatccgaaaccattgttcatgtcatcgaagatgcgctcctttcctccgcggaggttatagaactcgacaatctctcttacggaaggctcgtagtcgttggtcaggatgcagcggtatgtgtattctccttcccagaggtcaagctcaccgtccatccgtttccgcctttgaatcacaagccggtatgtcttgcctttccacttctctacaagaatggaattcagctcaaactcaatgccgttgatttctcccctcttccagcctctgagagcgaagaggtcattgtagagcgaactacagcggttggcacggatatagaaggtcttgcagtgggtggcaacctcttccacgatctcttcagagcacgagccgcaatcagctctgaaacgattgataacaagattgttctgttcaaacctttcgaagaatctcttcagcgtgtccttctgatggaaacggacgtttgtgttgccgtcgctgttctcaatgccgacaatcaaatctccaataaccgccacacctggtcgataaccaaggaacttcttgtatgtatgctttgcatcatatttctctgtttctatgaactggtggtcgaaatcaacatcatacatctcaccctctttcagctgaccagctgcacacatacaattgagcagtaaggtattgagggtgtcagccgtattgaaatcgtagttcttacccgtatctgacgtgtatgaaatgttctcctgcgtcagttcctttatcgctctgaggatagtgtcagagctgcaggtacgaagtgtcggatgaagcgagagatggggcatcaaatgagttgtgacatcctcaatacatgagccgccacagaagtagatgctcatgagagaacggatgatttcgctgtattgataaccatacagcctgcatcttagaccgagggttgtgtcaattacatatgacaatgtggagtcaaattgctccatcattgcaaatattcctccaaaaggagtgagtttctcagattttattgctttctttgccatgtctgtcgggtttgatacatattttgatttgcaacactaagataggtgaaaaatctgacatgacaaaatcctgagcaactttttgttgctcaggtacttaaaaagttatatttataatagtgttgcggaattaaggtatataaaagatgtgttgggacttgctgacaaaatcaagaacttgtcgaagatatacacctatgcccgcaacttcctttatctcggtcgtgggtacaactaccccaccgcccttgaaggtgcgttgaagctgaaagaaatatcctatatccatgcggagggttatcctgctgcggaaatgaagcatggaccgattgcacttgtagatagcgagatgcccacggtggtcattgctccaacggactcgctgtatgacaagataatcagtaatgtaaggcaggtgaaggcgcgtggcggtacggttgtcgccatcattaccaagggcaatgacgcaatgaaggacatcgccgaccattgccttgaagtgcccgacgtacccgaatgccttacacctctcgttgtttccgtcccattgcagttgctggcctattacatcgccatcaacaaggataggaatgttgaccagccaagaaaccttgctaaatcagttaccgtagaatgaatagaatattatcacttattgttaccatcctctttgcgttgtgcattgaggctggcatctttatgcttattgcccactggtggggcatgactgcggccattaccgtgatagccattgaatgtgtgttagccttatggacagtttacgaaatgagacatgcgagtgatgaaccagttgatgaataacattgcaggctgtggttagaacgaaaaaggctaaaaacaaaaggacgggtcgatgattcgtcctatttttgtgtctttttggtggcgaaatgtagcgatttagcaaaataaacataaattccagtgatattcagcatgaaaattcgcccatttaagtgaaaatgtgtaattttgcaacgcaaaattgtgcctaagcatttgcatcaaaacaacaatagttcaatcgaggctgatatgaaagtagagattaacaagaaacgtttagaatacctgctggcattatacaagatgtcggtggatgacttgttgtctcttctgaacaaaggcaggaaacggataacaggagccgcagacatcagtggagattctattgatttgggggtgttgaagcgtataggtgagatattcgacaaagaagtcagtttctttcaagactattctaagttgtcaaccaatgcaagcagcagtatcttcttccgcaagacctcattcggaacagagctgaacttggagtcgatccgtactgtaaaccgattcgagagtctgaaaaacgctttggatgcatacaacaaactgtcgcaactggatgtgaagtttgacatagaacactacaccctacaagatgaccctaagacagtagccgtacgtgcaagagattttttttatcccggggaaactgtcaatcataggcagtttcttgtgaagatgatagaaaaaatcgccgatcatggcatttttgtctttgaatacatagagacatggaacaagaaagagaaaaccaacattgacggtttttaccttaagcccaatgtgatagtgcttaagcatcataagcattacaagcgagaaatattcactctggcgcatgaattggggcattgtctattggggattgaagaagtggagtcggtggacatgatggacatctcggcacagacttcatacagtgatgtcgaaagatggtgcaatgattttgcatatcagttcattatgggacaagaagcagaaacacttgctaacatagcatgtgtagattcccgtaacgactactgcattgacctcttcaaggctatcagtgcacggacgcacattagccgtcttgccttatatacaaggatgtatatcgacaggaaaatcagctattcgagctacagcaatgtcaagagtgaattggcagaggaatacagaagaagagaggaacaggaaaagttgaaaaactctgagaagagaggcgggcgaacaccaaagcccatcatttctccgctattcttgaaaaccatgcaatatgcctatttcaatggagtggtcaacgagaccactttctgttcgagactcaatgtcaaaccagcaaattttgagagggagttatggcgatagttgttgatacatgctcattggtgatgattgccaagaattatcttcccttggataaggacggacagttgtactcattcctggaagaggcgttctcccgcaaggatttgatgctacttgatgtgattctggatgaatcaaaacgcacctccaaaggaattgcagttgaaaagatgcctttcctcaaagacaagaaattggtcattccgacaaaggatctatttccatgtgccccagagagattcagcaacatgatagacaacaatttctgtgtaagactgaagaagcaggaactgactgaagaagaatacatagagcaaaaggaagaataccttaaaacaggtgatgctaagattatcatttatgcactgaatgtacgacactcggacgctatccatctggaagagatgcaagtaatgacggaggaaacaaggcagcagaatgacggtaagttgttcaagaaacttcctttgttgtgtgagcagatagggattggaacactaaccgtttcagaatatctgcatagaaacgggttctttattgacaaatagcatagatattagtatcatcttatgacatctttcacgaaatcatattatattcgtgaataaaacacttgtttttcaagaatagaaattgttgaggattagatatttaagacattattgcaatgcggaaggggtgatgtgaacgacaaaagacaaggcgttctattagagtggatgcttgataagattgagaagaatggacgggtcgatggctcgtcctttttttgtgtctttgagtgtgaggtgcaggtggggaccagtactgcgaccactgttgcctgtcagcgcgatgatgatgccgggacggacgtgggtgcctttggtgacgagagtttgggagaggtggcaatagctgacggtgaagtcgccgtgacggagggtgacatagaggcctgaacgtttgtccttgcctaccttgatgacctcgccgtgcatcatggcgtatgtgggttcgtaatttgccttcaaatcaagcccgttgtgtagggcttttctttttgtaaatgggtctctgcggtagccgaaagggctggtgacagagatatgacggagtggactgacaagtgccgtgtggcggtcggtctgctccgtttgggtttgtaatggggcaaaggcaagagagtctcgccgctgatgcggcgagcacggaggcagttgttcggatgttgcggactgcgtcgtttttggcacagccttgcggtgtaccttagtctgtgtgacggtattgaactgagcgcatactgttgctgatgaacagaatattgctgctattgtgatgagtagaaatcgtttcatggtgcaaaagtaacaagcaattctttgactggcataaagaacaaagggaagacaagaagattgtaacataatatagcaatcgagtttgatttttgagcagaaatcaaactcaaataataataatcgtcaaaaataacacgcattatcttatgcaattctgcttgtctctgaataggtatataactttgcatgagtttaatttcaaattcaaagttaaagtatgaagcaagtacgatttgaagagagcgaggtgccttatcagacactggctcgttttggtctcacacaagagaagattgaagacctgcccatgtgggcgttggaagatattggtcagggacgacgttcaccgttgctgcccattcaggtgaataatgatgagggcgagacattgaagagccgcacccgatttgcgttggtccgtatggaggacggcaaggtggatgtggtcttctatccgcagttggagaaatcaccattggaggcttttactcaggaacagcaggaggacttgctggctggaaaggctatccttgccgatgttaaggatgctgatggcaggagcagcaaggctttcgtgcagattgacacggagaccaatcaggtgatgtcggtacctacgcctgtcatcgggcgcaacttggaggtgctgaaggatgaactgaaactgagttcggcagaactgaccgtgatgcagaagggtgagccgctcacgctcatcatggaggacgaacaggtgacggtgggtattgacctgaacgataagaccggcataaggattaatcaaggcgacagtcagaagtggaaggagaacaccaagcgagagtgggacaaatacaccttcgggtgctatggctgttgggtaatgggcgatgacggtaatcttgactatgtgcctgaagaggaatacacggaagaactttggaatgagcagaagaagaatggagagcgcaaccgcgcctctttttccatgcacaaataatctacacataatataataagtatatggcatcaaataaatattatccagaggatgtgctcgtcgagaagatacagagcggcgagtacggttggttggagtatgtcaaccatcattctgctgaatggcaggaagaatatgagagctattgtctgaacaacggactctgcatttgtgaagagagtgcggagcagtttgtccatcacaaagatgaggaactggagaaggcaatagagaacggtgaagcatgataaatgaagagtgaagaatgaagagtgaagaataagtatggcgataagaaagaatacgaatccccaacagatggacctgcaaccagagatgcgtgacttgctcatgcgcaatggtatgcaggctcatgtggtgagtaatggcagcggctatcagcttgtggtgcaagggcatgacagtccgctgcttacctataacatcaccgagaagcagatgttggctctgaccgactggggtacgaatcatgccaacaagttagcctacaatacctttacgggcattgtgggcaacgacttctatatgcccaagaacttcgttcatgcacgcaatgccaacggtcgtgtagctatggggctgcacggctatcgtgttggtatcggcgagtatggacggatggggcgcatcgatatgccaccaccctttttaggttggacaccacgcagtcaggagggattccatcttcgcagagttggaggacgattgttcttccccgaagccccgattgtgcctgaacgttgggacggcagaatgaagcctggcgaattgcagagcggcggttatgggttctattataagggacagcaacagagttatagccctcagcaacaggatgtgctgaaagatttggagggaatcataatgccttccatcagccgcacgagaagcacggagccagccaagccttataaggaactgattacctcgcctgtctatttcaccaatgagaagtggcaggagtgtctggcatcgcatggcatcatcattgatgagaatgcgaagacgctgaccattcagtcgaacagcgtcaatgccgacatggtgtatgacctgacagatgaggaactgaagaaactcacctccaactccatcaaggaagtgcccgtcgttcaacgcttggaactgctgaatggcatcatcaaggacgactttgctgacaaaatcctgatggacacactgaatagcaaggagcgcatcgacctgcatctgcatcccgaacttgaacaggagttgcagcagcgtcagcaacaagacgaggaacggttgcttccgttggaagaggacgagactgtcagacgtgacgtgttgcaaggcgatgccatggtgagaggtgaagaccttgccttgattaatgagaacaagggttggtatcgtgagggagcgcatgggcgtgaagtgaaagtcggtgacatcatggtggagaaagtgcctccgatggagggagataagaaaggcgaagataagtatcgcatgaccgccattatcaatggagaagccatcacgcacgaaatcaagcagaaggactacgacaagttcttggcggtggatgactaccatcgcatgaaactcttctccaaggttttcagtgaagtggatatgaagacacgccccgaaaccaacgccggactgggcacgaagatattggcggctctgacggcaggagcagtcgttacagcagaggtggcgcatgacataagccaccatcatcaccatccagccccggagttctatgcagagcatcatggcggtccacgtccttacttcaaaccgggagtggattcgccacaggagattgcggcaaggtactttgaggcagaagcaaatcatgttgccacggagataaggagaggatattaacaatgtataatttacaatttataatttataatgagtagtgaactgacatacgatgactttctggacaggttgagcatacaggaagtactggtggacgcagggtatcatctgaacaagagagatggcttgcgttatccgtcgtatgtgcgtactgacagtgagggcagacgggtgcgtggtgataagttcattgtcacgcagaatgggaaatgttgcttccaaccaccgcagcagaaggtgtataatgtcatttcgttcatcaaggagcatccagaaatgttttcagagaacaaggtgggaatgtctcctgaccgactcgtcaacctcgtctgcaaccgactgctcaaccaacccatagaggacagaccatcgaagattacagaaccaagaaaggacggaaagccattcaacctgaatgactacgacatccacaagttcaatccgcaggacagggaaacgcagaaaaggttttatccctattttaagttccgaggcatcgacctctatacgcagtatgcttttcatcggcatttctgtctggctactaagcatcggacggatggacttacctttgccaaccttgcctttccgcttgtactgcccaagacacccgacaagactgtgggctttgaggaacgaggacgaccgaagatggacggtagcggcggttacaagggcaaggcagaaggaagcaacagcagtgaaggactgtggattgccaacctcacgggcgagccgttggataaagcaagcgaaattgtatggtttgagagtgcctacgatgccatggcagagtatcagataaatcctgtaaagatggtgtatgtatctacgggcggcacacccaccgagggacagatgcgaggacttctgtccgttactcccaacgcacggcactatttgggttttgacaaggacgatgcagggcggcagtttgttgcaaacttcaggaaggtggcagcagagatgggcttccgtcacgagcatgtgcaagcctatcatccattgggttgctacaaggactggaacgatgcgctgctcaacaagaaatcagcagaactgattgccaagggcgaaccagataccttcgactatgccgagtttatcgcagccggcaaggcagagaaacaaagggaaaaagaagaaaagaacacatatcatagaagcgtatgagacaagaagataatagcatcatcaccttgtgccccagcatcggacagtttttcatcaacgaactgcctctgttgctgttgtgcgtggcaatgctcctaatcggaggattgcccggttgtgcatatagtaccctgttgcttgtcttcagcctcctgttctccctctgtttactctaccgattcatctatctgaggagtatccgctaccatatcgggagcgagcaactcatctgtgagcacggagtgtttcagcggagcgtgaactacatggagttgtaccgagtggtggactttgccgagcatcagacattgatacaacagttatgcggactgaaaagcgtgaccgtgttgtcgatggatagaacgacaccgaaactggaaatgaccggcatcagcaacagctatgacgtggtgagtgtgatacgaacaagagtagaaacgaacaaacgaagaaagggcgtatatgagattacgaatagataagatttggttcattgtcgtggcattggtactgagcgtgccgtcagcccatgcacagattgtgactgccaaccctttggaatggatggcattagcagagggcaacgaagccatcaacggtgagatagagaaggaaatcaaaggtcagaccaagactgccctgttgcagaataccatcgccgcagagttcaccaagatacacgaatgggagaagaagtacaacagttatctgaaaaccgccagtggttatgcctcttccctcaaagcctgtacctatctgtacgacgatggagtgaagatattcatcaccttgtgtaagatgcgcaaggccatcaacaataatccgcaaggcatcgttgccaccctctcgatgaacaacctgtatatggagaccgccacggaattggtgtccgtcttcacactgctgaaagatgcagtcgccaaaggaggcaaagagaacatgctgactggtgcggaaaggagcaagacgctgtgggcactgaacgacaagctgagtgccttcagcaagaagctgcatcgtctttatctgtctatacgatattacaccatgaccgatgtgtggaacggcgtgacggcagggatgatagaccgaagcaatggagagatagccacccaagcccttagcagatggcgcagagcaggacgtatgaccatcagtgattaacgataaaggaatcagtcatgaagtatttcatatcaattgccatttttatgtttatatcatcttttgcaggagtgcgggcgcagaacgacccgactcttgcggggatgattctgatgtacaccaacaaggcggagaaagaactgaagaatcaggagaaagtgatgctgctacaatccaccggccatatctggaccaaggaggaagtggaagccactaccgacctgcagcgggagttcaacaactatctggactccttccgttccatcgtcagctatgccgcacagatatatggtttctatcacgagataggtcagttggtggacaatatgggtggattggtggcgcagttggatgcccatcctgccaacggacttgccgtagccctgtcagccaagcgcaacaagatataccgcgagctgattatgaacagcatcgagatagttaatgacatacgcacggtatgcctgtcgggcaacaagatgaccgagaaggagcgtgtggagatagtcttcggcatccgacccaaactgaagaagatgaacaagcagttgaagcgactgacgagggcggtgaaatacaccaccatgggcgatgtttggatggagatagacgaaggggcaagacccaccaaagcgaacaaagccgagatagcagcggctgccaagaggcggtggaagcaggtgggcaagaacgtaaactgatggagcagcgagagcagagccgaacttgttcgagctatgccgagtcgtgacagaagaagacgaagtcaaaccgtgattaaaaaacgataagatatgggattttggagttcattattgaaatatggtggcaaggcggcacgaggtactggccatgtcatcggagtaactggaaagaccttaggcagtgcggcactccacccgcaacgcacccttatgggagccggcaaggctatgcagacggccgcagtgggtagtgccgcaggctatgtgacatgggagaagctgaccacagacaagagcgtggcacgcatcgtaggtgatgctgtcatcggcgagaatgccacggaagcggtggcacaaaccgccaacgatgtgcaacgtctgacgggcaaggctggtgaagccgttgatgcggtgaacactgtagccggaaagatggacacccagttcagcggcatcagtgatttctttaggaatatgttcggaggcgtaggatgcgacatgataggcaatctctttggcaatatcggcaagggcaacgtgtcgggtatgagcatcgtcggactggtggctgccgccttcatggtattcggacgctttggttggatgagcaagattgcgggtgccctgcttggagcgatgatcatcgggaacaattctaaggtggcgcaaactctgcctaacagaggcggtacgtcttcacatgggcagaacatgaaagaagcagagacccaaagcagagggatgaaacgataaccaatatacagtgatatgagatatacagaagaaatgatactgcgctcatcgagcggctactgtatgccgtttgaggagcctataaagcaggacgtgcagatgtccttgggttacggagagcagaaaaatcccgtgacgggagaaacattcttccatcacggcatagacttctcagtgaaccattacctgctgtcggcggtggcaacgggaaccgtctctgccattgggtcggacgcggagcatggcatctaccagaccatccgctacggcaaatacgaagtgacttacaggcatctctccaatgtcttcgccaacttctcccaaagcgtcaaggccggtcagaccatcgccatcagtggcgacctgctgcacatggaggtgaggtttgacggagaggaaatcaatccgttggagttcctcaccatgctctacggcaatatcaaggcattggagcacaattcccaaatgggcatcaatgaactggacatgaacatcccttcaccctacgacaccgaccgtcaggagatagaggcattgatgctccgcttccttccctcctacttcgaggaccttcaacaaggagcatactctctgcccgaacatacggagcagtcgttgagaaacatcttctcgttgggagcgagcaagcattatttctacgagaccatgccgagcatggctaatcccttgggcatcggcaaccgctgtatgcctttggcgactaaggtgcagaacctgctcattgccgactttctcaactatcttgccatgcgacatcaggtatatctctccacgatggacgaggtgttaaaaaaaaactccaagagcaagccctgacgcatgacggcatcatcgaccctcttgccgacttggacgtggatatccagagcttcgacattccgaggatagtgagcgtctatcccgaccgggctggcgtgagatggtggacaaaggcatggttcaatggtaaggaagagggggaaccctccgtggagattgaggaacgtatggccgtgcagttcatccactgccaagtggacaaggacgcatggttggaggaacactatcctaagcagatggagatatatcacaatgccatcgagcagacaaaggaacagatattacagcagtataatatataaacaaggtatatggcagttaagaacagtcagcgattcgcagagatagagcgtctgatgggcgactacttcgggtgtcaccttgcccccgtgatgggcagggtgcaacgggacttgtccaacagacaggcagacgagatgcgagcctactccaacagtacggctggcatcctacgctcattggccactgccaatatgcctggtgatgacccatacgccacgctgaagattacaggcaagtggaacagcaagaccaccgaagactatctggcgatgtgcaaggaggctattgtcggcaacaaggatatgcagcgtgaccttgccgtgatggctgaggaatggcgcaaggcggtggtgacggagataggacgagagcggtacgatgcactctctaaacaactcggttgtgatttggcatacgcctatatcgatcaccgcatggagcagctgatgatagaaaaaatggtgaaagaccgtatgccaacatcttctgccgactatatcatccgcaaggcggcacaaagcagtctgttcggtctgccctacgaactgaacaagtcaccccttgccgcagagatagaagccaaaggagaggcagcctataagccctctcgaacagagaaggcagcgggatgggcagccggagcgggtgccgatgtcgtggccatgggagggattggctcatgggcaaccttcgccaagtttgtcggtatcgatatggtgatgaatgtcggcatggagcacctaagcaagaaaggtagcagccaagaggtctgtgtcgaggagtgtatcagcaagggagttttcggtacgggcaccaacgtcttcgcctcattccgcaaacaggcaaaagtcatcaagaaccacgagaacagctatatcaaggctaccaacagccatttcaagaacaagattcccacgagcaatatcacttttatggattggacgaaacaaaccgagcagacctcttttccttggaacaaaggtacgttccttgaccctcagagaaacgaagcaaccaaacgtacaggcaagtacaaggatgtgcccttgatagttgcgcctggacaggaagacgagtatctggaggttaaggcgagactggatgcagaggctgagaaggagaagaaggcagaaccgaaagaaactcctgattcatcgactgaagaggcaacaccatctgtagtccagcaggaggaaacagccttacaaacaaacgaaaatggatgggacgggctgttgcagagttttggactgaacggcttttcagacatcggcaagaaccttggttatgtgttggcgatgctgcccgatgtactggtgggactgttcactggcaagacaaaatcgctgaatatggacaatagcctccttcctttggcctctatcgtggctggaatgttcgtgaagaatcctatactgaagatgctgttgatgggtatgggaggtgccaatctgctcaacaaagcgggacatgaggtgctgggcaggaaacagcaggaaggcattgcacctacagttagtcctgctgcatctcgcattcagtaccgccaatatcctgatgaaccactcaatcctcgtatcagcaacccgatgctgcaagggcggtgtctcgttgccaacattgaccatgtgccttgtaccattcaactgcctgacagtgtgattggggcgcatcagtcgggggcattgccgctgaatacattggctaacgccatacttgccaagaacgaccagatgcgacagatggcagcaatgcagtacgaagagcaggcacgggagagcgtggtgcgaccgaggggaatacagtgaagcccgacaacaaaattgtcgggaacggtggcttggtaagccaattatagaatgtgattgagataaacaaaaagataaaagcatgaaagagaaatcagaatttgagaagcggacggcggagaagcaggtgtcgctgctcactgaggcactgacgagtgcggtggatgccaagggacattggttgaatgcaagcggcaaactctatccgaagctctatcccaagggcttttcggtcagtccgttcaatgcccttgtccttgcccttgactccgatgccaagggttgcaagagcaatctgtttacgcagttctccgaagcgaaggcacggggtgagagcgtgagggagcatgagaaaggtgtgccgttcctgtattacaattggaataagtacgtcaaccgcaacaatcccgacgatgtcatcaccaaggaggcatacgcagaactgtcggaacaggacaaacagcagtacaagggagtgaaaaaccgtgagatccgtgtgctgttcaatatcgaccagacgctactgcctatggctaacgaaacagcctacactacggcattgaagaaggatggcacggtggaggatagaggttatggcgacaaggaggacaagcagctgcatgggtgcgtcaacggattccttcagaagatgaaggacaacctcgtgaatgtacgtcaggacggcacgggtgtggcgcactacgacaccgagaaggatgtcatctacctgccacggcagcgtgacttcgagcactacaatgactatgtacaggagatgatgcgtcagttggtgtctgccaccggtcatcagcagcggttggcacgtgagggcatggtcatgaagaacggcaaagccccgtcggaggatgccgtgaagaaggaacgactcatcactgagatagcttcgggcgtgaagatgctcgaactgggactgcctgcccgtctgtcaaaggacagccttagcatggtggactattggacgagggaactgaaggaagacccttgtctgattgatgccatcgagagtgaggtgaacggtgcgctgaaggtgttgaagaaagccgaactgggtgaaaaggtggagtatgccaccgaccagcatcagcgagagacggcgcagatacaggtgcagttgcccaaccactacttcgtagcagacgaaatcaagcagcatcccaacgaggagcagcgtactgtggtcatcgtgcgtgatgatgccagcaagaccgccgatgtggtgctgccacagggtgcatcgttggaggtgaacaacgagatcaagggcatgaacaagcaacgcttcaccaatgccttgcagaaagagggttatgacaacgtgcgtttctacaatcccgacggagccttgggcttccgtcccgacgacagttatttcgccgacaagaaaatcacggtatcaagactgcgcaactggtctatcgaagacctatcctcgttggatgcttctgaggccgtaacccacagccgtgacatcggtttcgacaatgtgcagttggtaaaggatgacaaggagcggtgggcattgtacatcaagcccgaaggtaaggagggctttgccgtctatcccgacaaaggagacctcaatcatttcttcaccaccttgaagcagtcgatggacaacatcgagcgtgtgcgtgaggaactggcacagaagtattatgctatggcagaggcgaaacccgacctgaaggtggacatcttcggaggtaatgagcaggaggttgatttgaaccgcatccagcgtgtggcagtattccgtgccaaatcgggcgaatgcctgtgtgcagccactattgacggcaagaagttgcagccgagaagtgtcagtccgtcacaatggcaacgattgtgggtggctcctgacagggattcctacaagcagaaccttgccgcctcgctgtttgctgatgtattgcagaaagacaacaatgtcgagcaaagtacacaagagaagcaggaagaagcgacggaggtgaagcaagcggagacggcaattgtcgataagcatgatgaacagaaggaagtggtacttaaggaagataaaagctctgaacaaagggaagagaagaaacaagaggaaaagaaagaagaaaagaaggatgaaaaggctgtcaaggctgctgtctctccccttgtccaacaatatcttgacttgaagaagaagcatcctgatgccattcttttgtttcgctgcggtgacttctatgagacctacaaggatgatgcggtgaaggcatccaaaatattgggtattacgctgacaaagagcaatgggcgcaaggatgatgaaggcaagccgttggcaatggcaggattcccatatcatgccctcgacacctatctgccgaagctcattcgtgctggtgaacgggtggccatctgtgaccagttggaaatgccgaagcagacaacatcatcgaagcgtggaattacggagatggtgtcacctggaaaagagacaggaaagcagatggcacaggaaagtcaagaaacagaacaacacaccagtctaaggagataggcttatgggaaagaacgcagcgtatgccgcacaatatgcggaggaagccaaagaacagatgcggatgtatgggattcctgcctccgtcatcttggcgcaagccatactggagagcagcaacggacagagccaactgtcgcgcgaatgcaacaaccactttggcatcaaggctacggcatcgtggttgaagaatggcggagagtatggagtctatacggatgataggcccaacgagaaattctgtaagtacaaaagcgtgggtgacagttatgagcatcactcgcagttcctgaagcagaacaagcgttatgcgcagtgcttcacgctgtcgcctgacgactacaagggatggacgaagggcattgagcgtgccggctatgccacgggcggcggttatgctgcaagtctgcagcgcatcattgaagccaacggactggacaagtatgacagtgaggtgatggctgagatgcgggcagaaggtcggtcgttcggggtggagaataatcctcgtagagaaatgcctgctgcccatgtaccgcagtctgccgggtattcctttcctgtggagcgagaggagtttctcttcatcacctcgcctttcggcaatcgccaggatccgatggatgccaccaagcagcagatgcacaagggcattgacatcaagacgaaccatgaggcggtgttggccacggagaacggcggcaaggtggtggcggtgaaccataatgcgaacacggcaggagggaaatccgtcaccgtggaatacagccgtgaggatggcagcaaggtgcaatgctcctacctgcatctgtctgacatagcagtaaaggtaggtgacgtggttaatgccagtcagaagttgggggtgtcgggaaataccggcaccagaaccactggcgagcatctgcatttcggagtgaagagtgtatcggctgacggctcaaaaagggatatggatccagccgcttatctggcagaaatcggacagaaaggcaacatcaagctacaggccctgcataacggcaatgacctgttggcaaaatacaagagcaatgcgccacaggagcagaaggtttcgtcggaggactggatgaagaaaatcctttcctcggaggacagcggcgtgggcatttcgggaacgaatgaccctatactcgacatggcgatgaccaccttcatgtcgctgatgatgttggcagcgcagattgacagcaatgatgaggaacgacaaaaaggacttatctctgccatggcagccaaccggctcgtagatttgacctcgcttgttccaggcatgaggcaatgcaccattactgtgggtgagaacggcaagactgtgcttcatgcagagagcggtacggtgaagattgaccgtgaactgacctcctcggagatgaaccgcctgtcgctcattttgggcaatgccaatctgtcggaagaaagcaaacggacgaagattgcgggaatggtgacaggcatcgtggcgacacagcaggcttcgcagaacttcgagcaagggatggaggctgagagtcaacaacaaaatctgcaaaggaaatgaaaaggatagcaagtcatctgtgtacattgctggtgggtatggtagctgtggcaggacacttcatgcttacccaatggcttttcggtcagaccgtggccatcatctatctcggcttccaacttatcatagcagcgtggatagtctatgaactgatacgtgcgctagtatatgatgattgaaaagagattattgtcattgctaagacatttcacttggacgatggatatgtataattcaaatagtatcgagcaatgatcaaatgtaatgtaacagtgtgcggaacggtcagcaaggctgcgacctgccgcacgaacaaggagggcaaggcattcgtgagctttgccatgaacgtagtcattccagcgaagagcgggattaacaagaccatcgaggtgtcggtcatcaaagatgggacactgacggaggtgggcagctgcaacatcggcgaacgcattgaggtagccggtgtattggtaccaagaaaatggggcgatgtcctttatttcaacctgtcggcaagcagcatcagccaccagcctgacgaggcagaggactgcatcaagggcgtgatggagttccgcggcaaggtgggcaagagcattgaggacaagacggacaagaatggtgtgccgtactgccagttctccgctttcagcgcagagaaagtacaggacggatttgaatacatctgggtaagtttcttcctattcgatggcaaatgcgaggcatggctgcaaccaggcgtgaaagcgaacatcaaaggggcattgtctgtcagtgtcttcaatgacaaactggacttctcctgccgagtgtctgaaatgagcgaatatgttccgcagccctataatggttaattgactatgggaaagccttatgctaaggaaggtccgagtgccgaagacaaggcactcgacctgtttgccgatatgatgattgagcgtattcagtcgctgtcgggcaaagacggatggaaaaagccctggtttactgaaggtgcgttgcaatggccgaaaaacctgaacggacgagaatataatggcatgaacgctatgatgttgctcctgcattgcgagaaggagggttacaagattcctcgcttctgtaccttcgaccgcatacagcagtttaacaaaactggcaagaaagacgaggaacagaagccccgtgtgtcagtactgaaaggtgagcattctttccccgtgatgctcaccacgtttacggtggtcaataaggaaacaaaggaacacatcaagtgggaggactacaaactgctctctcaggaagagcgcgaaaagtacaatgtatatccaaagcttcagacttaccatgtcttcaatgtggcgcagaccaacctgaaggaggtcagaccagagttttgggagaaactggaacaggaatactcgatgcccaaggtagagaaggacgagcagtttgcctttgaacccgtggataggatgatagcggacaaccgttggatatgtcccatcaaaccgatgttcggtgattccgcctatttctccatcagcaagaatgagattgtgatgcctgagaaaaggcagttcaaggatggggagtctttctactcgaaccttttccacgagatgggacactccacgggtgcggagggacagttagaccgcatcaagcccgctaccttcggctcggcagagtatgcacgcgaggaactggtggcagaactgacggctgcgctgaccgctcagcggtatggcatgacaaagcatctgaaaggagattcggctgcctatttgaagtcttggctggattcgctgaaggagtcgccgcagttcatcaagaccacgctactcgatgtgaaaaaagctacctcaatgctcacgcagcatatcgacaagattgctatggagatagaccaggagaaaaaggctgagcaggaaaacgggcaagggaaaagttatctatccatagatgacggcgaccatgcagtcttggcatataatggttctgctgtatatatccagcatcatgagaaggaggactctgtaaagattgctgtgccgacgagtaacggtctggaagtgaaactctctgttccttacgaccacggcaaagaccttgacaccaattatcaggaggcttttgcccagtacaaaagcctgacagagccttcacaatcgaaagaaaacgtctattatgcctccatcgcctatctccaatcaacggatgacacatcggaactggataagctaaaggagaaaggtgactatcaaggactgctgacgcttgccaaggaatactatgacgggaacggcatggacgaggagcagacctacaggaagccgtgccagaacagaggcgatgacctgctaatagaggacaaggactttgcagtggtctataacgggagtgtcggcggtacgtatgaggtgttcctgaagcatacggagcaagaagtgcgtgaccatatcactcgctatggcataggacgtgccagtgaggacgtgaaggctgtggcgagggagatgaccgccgaagagttttcggaattggcgcagcgaaaaatgccgatattccaaatgccgaatggtggtttgctgaacctgcaatataacaaggataaggatagcctggatgtggggactgtgaccaatgcaggactctctgtgaagcataccttccctttcagccacaaccattctatggacgcaaacatcagctctgcgtatgagcaactgcttgacatggaggagtaccagaaggaagaggtacaagaggagcacgttgccaagtccgctttccgaagatgagagtagtatcgtagtatatactaatcgtaggctttactactcatagtaggtactaacaatagtcagccgcaaggagtaatgtccctgcggctgatttaatttggggtcattccatattatgaaggaatgcttgtaaatcctcgtctggaatgctcttcagtttcaccggcttgaagccgtccaactgctccacttgaaatatctcgtccactccatatttggagccatccacctttacgctctccatttcattgacggaggtatagccatactccgtttcatgcagaccgcatacgatggtgaacaacgtggtgtcgttaccttccggctgtccttcaagtacgaaccaacggacgtgtccgatgaagaatattgccacacaaacggcatccttgcctttgccgtcctgtgaatacagaggataggatttcagtatctcctccaatacgggtgtaatcaatctgcttgccatagtcaatcgttgttaagtgttctgtaatacattctgttctctacaaggtgttcgatggcctctgctgccaatcggcacacccactcgtcacgctggtcataacgacctttttgatagtcgttggcaaggcgttccaagaaggcaaacaccaccttgcccttttcgttgataagatagcgatggtcatctgcaagggcattgcctaccttggcggctgaccccatctgaccgtttacgaaccgtgagaagcactcgacaaatgcctgctcgttttctgataatctgtgtaattccatacgcaaagaaattatttgttcaacttgtttttcttccctccttttgaagcctttcggctcctcttgtcgggaactgatttttcgtgcatcaaaagactgcggaatgagggcgataaggcaagaaaacagacggaggagttaatgaaatacccaaatctttgatttgcggaaagctgtcgttcagtcctctgcctgttagcatggcggtacttgaccattcgcccgggcagtaactttgcaaagaaaaatgggcatcggcaagtggaatagacactacaaaacaggaaaatcattgatttttagtgcatttttctttatttctttctttgatttaggataaaatatataactttgcctccgaaaaagtgtcacaagtgacagtttttcgtaaaatatgatagtaaacagatatagatacatagaacagttgagccgttcaaagaacaacgggctcataaagataatcacaggattgcgacgttcaggcaagtcgttccttctgaagaaactctttcatcagcatctattggatgagggcgtgagagaagaccatattctcgtcatcgacatggagagtaggaagaacagagagttcaagaacccggactacctgttggactgggtggaaaagatgatgattgactatgagacttattatatcatcatcgacgaggtgcaggaggtggaagactttgtagaggtgctctcttccttgtcagttaccgaaggggcggatgtgtatgtcacaggctccaactcgcgtttcctgtcctctgacctggtgacggaattccgaggcagaggtgacgagatacatgtgtggccactatccttcaaggagttcatgacggtgtatgatggttcgaaagaagacggttgggctgaatacagactgtacggaggtttgccgcaactacttacacaggttggggatgagaagaaggctgatttcctgcgtcgcctttatcgcacggtatatctacgtgacatctacgagcggaacaacatagaactgagacctgaatttgaagaattgtcgaagaccgtagcatccagtataggagcacctgtcaatgcactgaatatagccaatacgttcaagtccgtaagcaatgtgcagagcataaccgacaagacagtgtcggcttatctggaatatatgcaggatgctttccttatcgaaaaatccgaaaggttcgacatcaaaggacggaaatacataggttcgttgtccaagtattattatcaggacgtaggtctgaggaatgctattctgtcgttccgtcagagcgagccgacacatatcatggagaacgtcatctacaatgagatgcgtatgcgaggatggctcgtggatgtgggtaacgtctatcatcgagtgaggaatacggaaggaaagcagcagagggtgacattggaagtggattttgtctgcaacaaagggagcgagcggatctacatccagtcggcgtggcgtatgcccgatgcagaaaagatggaacaggagaaacggtcgttgcgtcttgtagatgactctttccgcaaactgctgatcgtgggagaacataccaagcagtggagcgacgaaaacggcatacagataatgagtatatatgacttcctgcttgactggtcaagtactgagaaacacggataaaaaaaagatatgcgcatagaatatgcgttaatacatatatgattaagggagggcctatccatcacggacaagccctccctttctaaaatttatcaatgaaaaaaaagttttagtgctcttgttcggagctgtatgtctggctatagatacagcaggattctggtatggcggttcgcctcattgggcgagtaatcgtcaatgccgccatcgaaaatctgagagatggtgccattttccataccacgtttcatcagttcctctgcaatgaatctggcacgggaacggctgaggttatcattgatggcttcactgcctgtggcactgtcggcagcgccgatgaccttaactttcaagccatatttcttggcgatgcgtgctacttcgtcgagattgacgagctgtgacctgttgagcaacctgtcagtgccaagttcaaagaagaaatagatgggcgcacctatgcaagcctttcctgagtggatgagcgataggtaatcgtcttccggctcaccttcagcattgccatattcttctgtacaagaggcggactccatgacctttgtcttttgaccattaccatacttgtctctcattcttgcacgcagcgagttgagaccgctgtagtcgtttcgaggatagccatttgtgacggaagaagcggcatcgtcagaaaagaggtggccgtacttgtccagaagtccctcgatggcaagaatcttgcgcagctgctccagagtctgacaatctcgatcgtgctgggcgtgatagcggctgttgctgtcagaaagggatgaggcgtatgccgaaagccattcgttctgtgcgatgtacgggcgagcgtctatcactcgcttccagccagtcttgccgatgcggacagagaggccgagggatgcggacagcagatggtcgccaaggcggtgtgccttgccatagccgtcaaaatcctgcatggtggtcatgttgcctatctctgccgtaacagcaatgcgtggggagagatgatactgcccctgtatgccgtaggaaatggcaaagggcttgtgggcattcaccttgttgtgcagcatacccacgcccacgtatggaatgacactccatctggcaagagtgtgtacatcgtccttgtagaggttgccgaggacattccacatgaaatcagcacgcaggtactggtagtcctgcgaggagttgttgcagtcgttgaactgcataccgccatagttcagacgaccgccgacggaaggtgtgaaccatttgccgatcgacacggagaatgccggtttcatgcgaccgaataggtcgttgcatccgagcggtttgccgaggaagaccgtagttcctcctgccgcttggacaaaccagttgtccgtccatggcgaagctaccaatgcccctttcatgtaggaaggtttaagcggacgaagcataccgtctgccgaaagtctgcatacaacggtggtggtgtccgccgtgcggtgatagtctttggcttgcgcacccaatgaaagggcgaagccaagggatagaataagtatttttctcatgttgttcaatttaatctggtgaatactataacaggtgatacgtgacagtgccgcttatcgtttcttccttttgccggaagaggggcgcatcatgcgtgcagctttcatcatgcaacggcgtgcccaagcgcgttcatcctcgtcatcgtcacgtccccatttgaggtcggacgaactgccgccaccgccatgaccttcggcaaaggtggtggcatcatcgacgtagccgaggaatagaagcgtggcacagtacatcacctccgttccattctccgcaaaggcctgaagcagggaaccgtcaaacacgtccttgccctcattggaaagccgtgccacacgttcggagaactcgctgaccatgttttcgagaagggcatttctgagaacggtgtccgcaccttgtcggatagtatcggaatatctgtgtgcctcctgccgcaactcctccgtgcgctccttcatggcggtcatctcctcacgcagggcatcgagcttgcggtcagcctctgagagcttctcctgcttgtcgtccagtttcgactggatagcggacagttcctgctccagctcttggacttgctgacggagagcatcaggattgtcgtgacctgcaagaatctgccgatgcaattcagcaagtgccgcctccttctcagccttctcctgcaagaggttgttgaccattgaggtgagtccttttactctccgctctgccagacggatgtccgattggagcgaggcgagtgtccgctgatgggtggcgacggactgctcaatggtggtgcactgttctgacagctggcggcggtattcttcggtggtgcggtggcgtgctcccgtctctgagacggaagttccgcgctccatgccccaacgcttgttgacatcggcaaattcgctgtgcagggctttcatcctggcagaaaactcgtacttgtcctttccggcgaatatctgtttgtatgcaaacttgccgtccttgattggcaagagggtgcagtgaacgtgcggattggtttcgtccaagtgtaagatgaaagcgacgatgttctcctcaccgtatttgtccgcaacaaagcggtaaacatcctttgcccattcctcaatgtccttgcatcgggttagatgcgaattgtccgctccgtgagtgagattcaccttctggtcaccgaatgccaattctgtcatacgttctcgtgagcctccgaagatgaaattgaccactgtgcggaagcgtggctctgccagtccctcgttggggtctttgattccacggctccgcaggatgtctgccatgcgctccgggatgcttcggctcttgtctataggacaaaccttgccgccccgaacctcgaagttgagccgctcacggctgcggtcgtagttgcctgttgattcagcggatccccaacccttttccgtccaacggcgttggtgctcgttgctctgtgctgtggtgattcccttagatggtcggaaatccataacctgttttggtgttgccataacctatttccttttatgtgtgtacaactctcctgtctccagcttgctgcttgtaaggacagcctcccgatggtcggagaccaagaggggtattaggctacccaaattccctcatttccgaccaacgggcaagcccgattattttacagcaatggcagacgtgtaaacactgtgccagtagaaaagaagaagcgttgtacggtgattattagaggttaatacagccttttgatggacaggagccctcttggttggctacaatggcaaggaacggtcggcagagtgactgaaactgtgacttgatggctgcgctttcctgatgcaaggctggtgagctgccatccaatgccaattctgatattgcctttgccgcctcgatgaatgagagccagtctcctcccaggtctttgtaaaagaagggaagaagggaggtaacgagggcgttatctgtttcctgcgaaagcacctgatggaaggtggcttcgcagacagctgtgagtgcagtcatacaaaaggcgtgtcctacagattcgggaatgtttcttccgcatggcaccttgccaattgaattgccattgtcggctttctgcaagataatggctacttcctctgttgcatcttcgtagagttgttcacattccgaggcgcaagccgatgcggacatcttgccgcttcgccattcgtccaatgcggtacacatcttctggcggaacacatccaaggctgcgtcaatcggagaaacggcaggtgtctcagccaacatcgggatggtgatgatttggctcttcgtgagacgggtgacggaaatctggttcatcttctccaactgctcgatgaaggtgcggacagtggcgcggtgccaatgccagcatcctgccagttcggtaatggtgattacaaactgcccgttggacaggctgaactcctgcttgcacagatccttggggatgtactgtacagaagccttgtctacaaggtcaaggtaggcttcgagcttcgacagccttatcccggacctctctttcaagaactccaacagggacatccgttcagacatcttgccggaactcgttctatgtttctgtttcttcatttcaataatctgtttggtgaatactgttgtttgtcgccagctccattatacaaaaggaacggcatgatacaggtgatacttaatagtagtatatgatgagcatttctgtgtcttcgaggagcatcttgcggtcagccttgttcttccacagcgatatgactatgcgcgagggatagaacagtgatgccagaaggacaaaggagatggtgacagcaagcgtgaacagatgaggagtgaagacaaacaccactgccgccaacgcggcgatgcagaagggtgtccgctcctcgtgcagacgctgtagccacctctccacatccataaagacaaagaatatggcaaacgctatggtggaagccactacgcctatgtcgttatagtgtacacagaggtagaggaagtggaacacgtacagcaggatgagcagcatcaaccggtagagcttccttgctgtcacaagcgcggtcatgcgcagatagaaccgtgtcataaactgtctgcggcttctgtgcagaatcatcgtcacaaagaagaacgctgacatcaggatgagaaacagtatcttacttgtcataatatgtatagcatgtgaataatggaagtggactcaggtcgggctggacgacaccgtgtgtggcagtggatatgatacgctccacatcctccagtgtcagttctcccttgattattctctgacggaaagctccgtcggttgtccgaaggctcttgatagcctgttccaagtcgtactcggctatctgccacacttgccctctcgtgtaggggaaatgatggtggatggccttgaccacaagcacacggctgaggatgtcggtcattctgccgttcctgactatcgtgtggttgcggacagtggcgatgctctcaatctccagccatgtgcggtgacggtcgagaagatggataatcttcatgtaaagcgtttccttcatcagatggtcgggagcttgtggcatgactttggcctttgttgtggacaacagaatggagcgttgttgcggtagaacaggactgtcatctggcaaatgtaactttcaaatgaagtcgagcaggacttcctccttgggcttcatgtatttgaagaacccgttcttgcaatgcagactgaggtcgaggcatacatctgccgacatgtgctccagcgagtcatagatggtcacttttatctggctgaccatgccacgctcatctgtggagccgttgaccttgaacatccgtccgaaagaagggttggaataggcacagcagctgtgtccgaactccgtatgacggcttggaatgtggtgatagaggattatcatttccatctcgtcttcgagcatatccatcacctcctctatcgtgaaaggggtgttcaactggaaagtaagaagcacgtaatcgtcatacttgacaggcttctccatcttgcgcttgtccagcagttctggcaactgcaaaggcacgacggcaaggaaatcatcgcaaaactgttctaacataatcgtattctctgtttggggtgtttataatcttgtgacataaatcttcatcatgagcatgggcatatccgacaggcgttgcttgtcgaggtgcagtttcttggccagaccgtccatctccttggggagcgcatcggctattttgtagaggtctgccttgtccttgtcggagagcacgctcacggaaaggtcatccatcgtcatgaacggctgcatcatcatcaggaggtaggcgtgcatggtgtgctcgtcctttaccctgccactattcagatcctcgatagccgcttgtgcgttgcgcagcagacggtggttggtgcgcatggagaggtatatcattgcatccttgtgggacaaatccttgcggtcggcggcacggagtatctcccgacagcagtgttcggtgtttcgtctgatgtcaccgatgtcatcgtcagcaaaatccggcaggtattgcaggaaggatttgaaatacaaatgctcttccttgatgaaagcgagcaggtcttccttgccgtgaatgccttgcttggcggatttttgcaggaacagcaggtaacgcttcagtaccgcctgtttaccacctttattatatataggcaggctatccaaggaagcgaagaatggctgtgcttccttcacggcttgctgtagttcctcatcaccaacatgggaagaggtctgttctctgagatagagcaggtcgtgaaaggtgcgttgcttagacatcgccatacggcacagctcgatgtggatggagtcgttcaactcatgatataccgtgaacgggtatgagtgggctttcctgacagtgtcacgtgagatgcacgatgtcacggaatcgtccaacacgcgccattcgttgacaatcttaactaatgtctgaattgagaccttgccgttctgtcgaagagtggtcagaaagccatgatactctctgatggcttcatcgctcgaatggaacgacttcgtgccgtttccgtctgaacatgctgtcagcatgactacggcaaacgcagtggcaatacaaatggcaagtctgatacagccatgcgagtttgattttgcattatgcaatatttgcttcatgcaatggaggttggtttgtcctccgaaaagttgggtttcatatttcattgttgtcattattttgagtctgattttgaaattgacggtgcaaagttaatgcgtttcagcgatatatttgcaagaatgacagtaagtttaatcttatttgtgtatcatacttgcgagtatgattttcaatgaaatcaagtgaaaagaaaatggcaaattatcgtgtttaagtatgatttttcgttcaagtatgattgtttctcggaaaaatagtgtacctttgcacttgatttcatttaatagcgtacaacagtatggcaaaagtaggttacatctttatcgccaccaatggcgaagagtatgcagaagacaaggcttggatgcagcaatacggctgtgttcaggtgatagaggaactgtccgaacacgagaggctgcgcccgatgtggaagcagctcatatcgagtctggagcgcggcgacgagctggtggtgtcgaggttcagtaacgcactgcgtggcacccgtgaactggctacattcatagaatactgccgtgtgaaggtggttcgcatcatctccatccaagaccgcatcgatacgtttgacgaacttttccccgacaccaagccctcacaggtcatccgtatgttcgggtcactctctgaggagtgtgccgtgctgcgcaaggcatcggcacacatcatccatctgcaacagaatatccggccgcccaagaagtcggaaagggcactgtcgaaactggagcgtgagaagaatatcgtgaacatgtacaacgaggggcacagcatagatgacatctttgccatcagcggcttcacaagccgaagttccgtgttccgcatactcaacaagcatggtgtgacgctgaaccgtggacctcatagtggaccgctgaagaaaaggaataaagaataaacaaaaaacagatacaatgaataagacattcaacatctactgtgatgaaagcacccacatggtgcatgacggtcatccctacatgcttttgggatgtacaagtatagcatacacacaaatccgcatggcaaaagatgccataaaagatattaagaagaagcacggctatagtgatgagctgaaatggacaaatgtccacgaggccacgtataaagtctatgcagagcttatagactggttctttatgaatgacatggaatttagggctgtggttgttgacaagagtcagattgacgagaaacgagaagactatacgtttaatgatttctactttcgcatgtactaccaattgctgcatcacaagatggacatggattatacatataacatatatatggatatcaaggacacatgcagtagcgataagctggagaggctcagaaaaataatggaatacaactcttccattggcaggtttcagtttatacgttcacacgaaagtgtcttcatccaattggcagatgttctaatgggagccatcaactacaaccttagatatgaaaagggagaagttgaaggaagggtgagagccaaaatgaagctgattgaaaagataaaaaaacacagtaatatcagtctcaacaccacaactcccaaatttagaaagaagtttaatttgttttttatcgcactgaaatagccaatgagcagtttgaatattatcaagaaataccctgagctgctggaactggcatatctcagtgaacgagaaagagagcatgatcttcatgcaatattcaagcgtgatatagaagataactgtcaattctcattcagagggtggcgcatctatcctataaagacagatggcgagattgacatggcaagattgttcaagcatcttacctgtgaagaaatcatggttgagaacgaagacggtacgacttatccaaagcgagtattcgagatggctcgttcacaaaggcttcattggataaatcaccatgtgagagaattgacaccagacaatctggatgtatttaccatagaagagagggacggcaaaaagcgtaaggtcaagaaaacatacatctatgataaagtggaaaagtatgttattgtcttggaacaacaacgtagcaacggattctatctgttgacagcataccatcttaacaaagagtatggactaaaggctttggaaaagaagatgaaaaagagattgcagacaccactataaaacgcaagacccgaattgcatcaaaggcaaccgggtctcgaaactccttctatctatagatgagcgctgcaaaggtacgaatattctttgaaataacgaaggtttttcaaagaattcttctcgattttaacatttgcagggcagtattgtaagataacaggaaagaaaatagcataattttacagaaaatcgtaatggaaacattcaaagacgttatatcaagtgaccaacttgtcttggtcgatttcttcgccacctggtgccagccatgcaagatgatgcaccccatccttgagcaggtgaaggaagtgttgggtgacagaatccgcatcatcaaggtagatgtggacaagtatggggtgactgcaagtcagtatggcatacagtctgtgcccacattgatgctgttcagacgcggcgaagtgttgtggaggacgagcggtgtgatgcagaaatcagagttgctggcaacgattgacccgtttttaagataaaagagcagaaatgtcaaaatctaaattaaagtctgtcctcatgtccatggacaagagtgaaataataaaaatggtattggaactttattctgcacggaaagaggcaaaggaatatcttgacttctatgcagagccgaatgagggccagaagctggaagagtataagcacatcatacgggaagagttctatccgagcagaaacagagagccaaagacacgcttctcagtgtgccgcaaggcattgtccgacttcaagaaactgaagccttcggaagattcagtcgcagaattgatggtgttctatatggagaatgcctgtcagttcacttatgactatggagacatgtgggagcaattctatgattctgttgagagtaatttcgacaagacattgcgccacatcgtgctttatgacctttgggacaagtatgattcccgaatcaagcaatgccttcgttgggcaagcccttgtggatggggatttcctgacgcactgaatgatatgtatgaggaaatgaaggcgcaaaatgaggaactccgaaagaaatacaggaatttcaagatgcccatcaacgctgattattaaacgaatatactcaaatggggaaaccaaagaaaaaacataagaaagcgaaacaactgcccttaagcaaagaagagcagatttttcaagcggcaagagaccttgcagctgaaattggcatatcctattctgaggcattagggtttactttgggcataaaggacgtaacgtatggttgggaagaagactatacggaagaagagtttcaggcactgattgaccacgctgtgggagacactgattatgagcacaccctctattgaatcatctacacgagaggaacgtttggattacgttctgaatgaatggagatgtctgcacaactgtgagctgtgcggtaagtgccatattctgaaaggcagaagcgaagaaatactctatgcagactatatagacggcaagcggtcatatatggatataacattagaaatcagaagcaacagataatgatgtcacagaaatacatatatccatcgttgttccaagaggaagagccgcaagaaagcgttcctggtgataagaaagagtatgacctgacgaatctctttgagagattggcaaagtctgattttcgcagccggttccatctgtccaagcaagacagggagtatgtaatggaaaagggattgccgacgatacgaaaacacgcagaggactttgtggcaaaaagacttgctccggctgtcataccgaacgacggcaagcagactcccatgcgtgggcatcctgttttcctggctcaacatgccactggctgttgttgccggggatgcttcttcaagtggcatcacatctcagcaggcagggcactgaccaaggaagaacaggaatatgctgttgccgtattgatggcatggattgaaaaacagatgaataaaggatgaagatagaagaagccatagtatatgtgatggtaaagcgaaatggcggcatgacaaccgaccagattgccgatgccatcaatcgtcataggctgcacctgagaaaggacggtcagcctgtgacaagcaagcaggtgtatgcaacaatctgccgtttccctgaaatgttcacaaaagaagctggcagaatcatgttaatgatatgacgtaacgatatgacaatagatacaaccaacatgtgctcacaccttcagaagaagttgtttgaaccagaaggtgtgtattatccgatatggcaagccatgcaggatgatgagaccttgacagcagtggtacgaagcagacagctgcacatctacagaaacgggaagaaaattctcgttctggcaggtaaggcacaaccgaagattataagggaagacaaaatacaagagttaataacaagattataaacaaaacatcaaatcatcaaaacaatggacgcaaaagaaaaagtattggcaacaatgaaagaggctggtcagcctctcaacgcaggtaaaatcgcagaactcagcggtctcgaccgcaaagaggtagatgcagccatgaagcagctgaaagcagagggtgcaatcgtctctcctgtgcgttgcaaatgggcacctgcagagtaaggtttatactgctgtcttgaaatataggcagcagtatctttatttttatcaaaatgttaaggtgaggaatctgaatatccttgcctacggacacaattatccgctgcatctttttggggtaaggtgcagacgtatggctgtcagcgtatcttggtttaaagacgcttagcggtcacggcggaagtcgtttcgtctctctccgccgaacaaagctctgagcacattgcccaaagctccgaacacgaagtagcaaacgatgattgcaacaatatcgtccataagcattttctgttttatgggttatacactattatgaagattcactatgtccaatccctgcctcttggcttctctgacggtgtagaacgtgccgcccttgggattgccatcgaagtaggctatgagacgtgaactgcggttgaccatatagtcgttgcgcctcagaaggcagccattgtagtattgctcgctcaatacgaccacgtcatccacgatgcgcaggatggcatcatacttggcttgctcttccttgctccaccggtcagactgaccacggaacggcacaacggctatcacctgcaagtccttcaactcgcattgcaacgaaagggcggcttctgccgccagcaggtcaaatcccattgccatgccacaatagaaataccggtagccgtcggcatacgccttggctatctccgatttgagacattgcttcaactccctccgcttggcgaaaggtacgctgcggtgtccgctgaagcatacggacactgccttgtcgtactttgtcatactttaccttactttataatgtgtgcgtgcgaggaacataccgccaataacacatgccccgagcctttcgagttggttggcatacttggcatagctgagacccttggttatcacatcgtcaaagaccaacaccattttgttgtcgaagaacggctcatcaaactcaacgacattcgccttgcggacttcatcctcgttcttgcggttatcgtggatggtcttacgctctccgcataccctcacgtgctcgtagccgttttccgctcctgtcaattcacacaccctgtggcagaaagccttgtagcggagttcgttgctctcgcttgtggatgctggaacgggggcgaagacgatgttcacgcaacccttgccgtagagtgtcagcatattctctgcggtgcgctgcgccacttcctcgtaggctcttccgtccttgaagtcaaacactaattgtctgtcggcaatctccttctcacccacattgcggatgcgtgcgggatagtatttgcagaaccaagtctgaggcttgtctaactgcttttggatttgatagtcattcttgtgtgccattgctcttatgttttttcttcccttatttcggaggcttttcctgcctgcccaagggatattttttgctttccaagagtgatggcgatcaaaaagccaaatcgggagcgaaaaatacgctctgcacgcagaggaagatttttcggtcaaatgcaatggacgatttggtgtttgaacaatcgccagcattacctttgcaaaacaatatccgcagcggcaaggcaggcgaaaagaaatctgttatgtaaaagaggaaacgggcgggatggcgtggggcgaagctgtatatggggaaggacgatagttgatatgagggaaaaagagaaaatcttgtaatagggaacgacattgccttttatcagcatggagacagtcctacaagcagagaaaactattgccctaaaaatgagttggatagtattttctaaaagtagtatcgactacgaatagtataatagtcgaatagtttttactaccatactacggatagtaaagtctgtttatagaagagatagcggtatcatcgtctgttcggcgatgataccgcgcggcactcatgtgtcatgccgctttaggtattctgtcattgcctcattgacaatatcacgcaaggacatccctttcttgatggcgaggtacttcatcctcgtgtggatgctcttgttgataaggaaattgcaatgcaccggcacttcggtagtctcagaaacagacacaggtggtgctggtgtagtttctgtgactatctgctccttactcggcttctttgtggaagaaaggagtccgttgagaccgcctttcattccctctttcaacatactgctcttgctcatggctatgctattttaagtttaacacttcttttgccaaagacatataatcactggcaccattggatttgggattatactcaaagatagtcttgccgttgatgggtgcttctgccaaagccacattatcacggatgacggtcttgaaaaccttctcgtgaaaactgtcattgacgatttccctcacgcttcggttcaacgtcttgcggcgatcgaactgggtgatgacgatgccgcccactttaaggttggagttgagccgctcctgaacgatgcggatgatgtccatcaactttgccatacctctcatggcaaggtattgcgcttgaacagggatgatgatgtagtcggctgcggtgagggcattcaaggtcagcaagcccaatgacggtggacagtcgatgatgatgtagtcgaaatgctctttggcgatggctttggtgataagtcccttcaagataagctcccgtcccggctcgctgataagctctaactcagccgcagacaggtcaaggcatgagggtgagacggtgatgccgttgtgcaacttgaccaacggcaaggtgtactgtccacacattgcgccatagactgtctgttcttcctcgatggacaatcccaaggcttccgtgaggttggcttgtccatccatgtcaatagccaagacgttcttcttactcagttgcagagctgccgcaaggcttactgcggtcgtacttttccctacaccacccttgtgatttaatactgcaattatctgtgtcataacatgatactactattagtgaatactactttactattctactactgatagtacatactaaccatagtaaaagcggatttactacgattagtacgtactactctcagttgatactaccctcagaagggaaggtcttcgctcttgtcctgcggtgcatcggctggcggtacgggagcctcgccctctgccttggctgccttgcgtgcctttgttgcaggtgtgtcggttgcatccttcttccctgcattgacaaaggcgatggagtcagctatgatgctatgctgtatgtggttctctccgttgcggtctgtccaaatggaagaagtcagtgtgccttccacaagcaccatacgacccttggtgaggtattcagccaaacggatatggttctccttgctgctcttcacccttacccaagtggtgatttgcttgcccttactgtagtcgtccactgcgatgtcaacagccatgaatgttccgtgtgtacctgtgatgacgcggcaatcctttgctccgatgcgtccgatagtgtgagtgtaaatcataatgtgaaaatgttatagtggcaagttggttagacttgccgttaccttgttatttaaatgacttttcttgttgattgaacataagctattgcttcattcataatttctgctcgtgacctactcttgttatcttgcatccactcatcaatttcagatttgaggaacatgatacgtttccccttcttatggaatggtatttgtttattgcttgtccaacaatagattgtgtgttcaactggatgggtagggagatactcactcaattcggaaacactaagccattccaatcccttatcgggctgaatttgagtcattagtgtggaaaacttttcttctaaaatctccagcttgtttattactaatgacaatgctgatggcaagtcattaaaactcaatatttgcttttccatatcaatatatgtgtggcaagttggttaggcttgccgttaccttgttattaatatcctttcttcgtctgccttgtattggcgacaaaagacttgttgctgcctgtgagactgatagagccgcaattaacaaactctccgtcggaatagactctgtacttctgtccgcttacctcatgcttctgtttgatgcgctctcgcatccacttcttggctgcggtcaatgagcaaaaggtctcgctctccttggtcgtctcgtcatatacgatgcactgggtcatacatgctcctacttcatccatgcacctatactcgacgtgacatagtccaactgaccgccaaatatgtcgcttggctctatgtcgtattgtccatccctcacttccttgtcctctccaagaagcgacaagtttccgtcggcatccaaacgtgctgcgtctatgacgatgtcacgaggctcgtcaaagagataacctgccacgatgggctgctctccctcgaaatgcacctcaaagcctccgtccacctccgtgccgtacttgcgaagagccgctttcagctcgtcctgctcccggtgctgcaatgcctggagttgtccgtggatagtgaggtcttgcagttctgcctctcgtttggtgtgggttgcctcgccggtcttgcagtcgatgtcatacttgtggtaaaccactgggatatggtctgccgatgtgacaagccatgtgatgttgttcactgagaagccctgtctggtgaggaactcctcgatgtctgagccgagaaggtggtcggctacgtcaagatactcgatgcgtgcgtcagcatcatgcaggatgataatcttcattgcctttctatttttagtgatacaaataagtttgtcgcccatgtcgctggacttgtttaactacgttgaagaaacttacgctcagcatagtgaataaattccctctgcgttcgcttaaccgtttctttctcttccctcctttcgagacctttcagcctgtggagggatattttctgctcccacaagccgcaagaaaagacataaagacaaattatgtgtgaagaatactcttttccgaggaaaaggaagattgttcacagtcacaagacctcaagcagaatttgacgattgtctcagacgcggctaactttgcaggaaatatgcctaccactgcgctgattggaagaagattattgatattggctgcaagaggaatgatgtgttatatataaagaggtaagaagaaagattgaaacagtaagggtgggcagtgaagtgtttgcaggtctgctgtaccgacataaagcgagtgtgttggctgaccgggatgcaagtcatcaaagcttcagccttgatagcttgtagcacggacagacaattctctcgcgtcggtacttcggcatactgtcagctttggctaatagcaacgtgttgccatcagccaaggatgtctgtatgacgacagaccatgtaacgcttcgcaaaggcgtggggcaaagcagtataatttagaagtagatagtaacgtatatcaggcaagaagagacagttgcgcaacggacaaatcgggcactcctgtcagcatgacaaatgtgccttgtccttgccgcaggacactgaggcagattggacgtagcagacatgtctgccacattcaatatgcctgagtggacaagaactgcctcttgtatagcagaagagaaattgtaaaacagttgattagtggtaaaggtggtatgggtgggcagaatggcattacacggacattgccgaagcccgataatgggacagccagacagcaataaaggcagttatcagaagtgtcagtttctgatagtgacattgttggctgcctgtcacatgggattcgtgcggtgtccgtacagtaatgccgttctgaaggtgtggggcgaagcgatacaacgcacttggacgaaaccaccgcttataacagaaaatattttgcagtcaaagagaagaagaatagtaaagcaggtgtgggtgggtagtgaagctgtcgcaagattgacggtctgaatatcaaggcgagtggatagccagtaaaggacacaattatcagaagcctcggcttcggcatcttgtggcatagatggcagtcctctcgcgttcagaccttggcatactgtctttcttggctaatagcgactttgtcgccatcagccgggaatatctgtatgccaaccatcttggtgacgtttcgcaaatggtgagggacgaagtggttagaataaaggaagacggcgttgccgttatggttaataaatgcacatggttgttattagagaagattatcacacgctataacagcagattgatgtccctgagcaaaacaaaagcgacccgaaggtcgccttgttatggagaggaaaggctatttcttgcctttcttggttgctggcttggccggctcttccgcaggagtctcctccttgtcgggacactcgtagaacttggttgcaaccatgatgattctggagtgcttcacgccatccttgtctgtccactcctctggcttgaagaaaccctcgacggtgagcaacgtgcccttggtgagcttgtcgaatgattcggtgtgctcgttcttgcgccatgcctccatattcatgaaagccgatacgcggttggtttcctcgccgttcttctcctgacggcctactgccaatgagaagcgtgctacgctggcgtttgcgaactgacggatttctgcatccttacctacgaaacctgaaactgtgaagttgttctcgatctttttcattttgaattgaatttaaaagtgaaacttaatttttacatgcattcaaaagcagggatgtggcaccatgtgggaagcaccatgaaaatcgttcgcaatactctttttgtcgttggcggtaagggagaaaaaggaagattacgcactattttattggtcacagcgatagcggccacacaagaaggaggaagtccttcgcagcatcacgctacctttgcatggtaaaaataagtggctttcaaatagctcaattcagaaaaagacggggccaaacaatggaacaaaggttgtaagcaaggaggcaatccgtatgcaacagacaggggcactgctatggctgtatgcctggagaaacgaagcgggaaatccgaccttacagctgtatcatcagaagagtgaggagcatgaacactgatgcacgatgaacgacaagcctaagggtcagcttagcaatagaggcatcaagccaaaagaggacagacatcagaggattggcgatagcactgtcatcatgctaagaccaagttctgtgtccgacaaggaagagtcgcaaaagacagacgagtaaaaccaaaaggcgaaatgaccattcctataacaaggtacagagacgcttaaaacggcgaagggactttggcgacgtatcgctatacaggtgtcgaagcatcgcttctataacaggactggagcaagtgagcaaaccgcacaacttgctcccaaggtatttcagttacaacagccataacctcattggaggattgtcctaaaagagtttttgcagtcaaaggaagaaagagtctgcaagccacatagccaacagactctctcctgattattcacagatgacaacatcatccttgtactccgtcacttccttgccgttgatgagctggacaatgacctcacaacccaagtcctcgacaatcgttccctctgtctgacctcttcggggataaagcaaggtgcagaaacaccctacaacgccgtccaactgctccatgtctatcgttgccatatccgttcctccttgttagccgaatgtgattggattgatgcagaaattcgtgtcctctgcctcatactcgtattcattgatgaagtcaatcatcttctgttcgcttcttccgtcctgtgagacaccagtcttctcacaccacaacttgatagcatcaccaaaggtggagtaagcaccctcacaatcctcaaagagttctccgtatgcagtgacgtagcactcttcggggaagaagtcgttctcatcgtgcgtatagaagatgtcgcaacctggctcaacctctcgccaactgattgaaagttcatcgccaagtgccttgttcacctcctcaaagaacaagtcgcatgaagaccaagcactttcggtgtcaaaggacaagagggcataatcgtcttccacgttctcctcatactctgcccaatagatgtgtcctctcaccgagatgcctttcttctcgtagtcaatgccatagtgttctgccaagagatacagatacacattattactgttcacctccaactcttggagtgtgttccaaaggtctgccacggctttgcgtgagcctgtcaccttgtactgagtgtcgcaaatgttagccataagataaaatttttattttcttcccttatgtagaaccaactaccatcgggattgattaaagaattatgttgccccaaaaggtgttatggctcatcaatgcaaggttttgccgtcaaatactacctctgccacaatcagagcgtggagatttcacggacaaaccacaggcaccgaccttgcaggatgaacgccatgacaggtacctttgcaacacaattcttatcaaagcccgatggggtggtacatggcagactgcatggtacagcagtgtgaagtgacgttataggtggagataaggctataagaggtttttgcagtcaaaggagaaaagagtccacaaagtgcagtatctacaggacaaaaacactttagtttaccttggttagctcttatatatatgctaacctaaagtaaactgtatatatgtccgtctaaaacccgaaaaccgtacgggtcagcttacgtcagaaacagaagtatagaaccatagaagtggttcaagaagtctttcttcctttgactgcaaaatattatctttgcacgaatcataattgccctgtaggatttaatataatttaacactctttgttgaatgcaaggaagaacagcttcaatatgctgaatatcagtagtataacattgtgttaacccttaatctgtagaaaaggatgttatcatacaaagtaatgtccatttgtactttttctatatggttttatacttacatttgcatatcatttgtatcttgataacagtaactaactgattatcaatatactttatatttgaggaagttaaattgacattacccaaatcatgatatacagctcccccacccgaaaaccgacgggctatttgaatctgttgttcttccgcccattcccggttcacttccaactgtacagattggtgttttcccatcactacagaaggagtgtcctgccaaagcatgaaaacagaatctgtttcctgcttcagcaaatactcttctgccgccagatgaaaataaatatctgtaaaagtgttatgaaagcacctcatgataaatctctccaaccgtaggatggggaaatacattcttctgaaattcctcaaccgtatagcccttctgaatagctattccggcaatcacaatcaattccgacgcaggatttccaagcatatgacaaccgataatatgatcagcttcatcaagtatcagcttacatattccatttacttgttcgttttccgcaacaaaacgtccggaataagccatcggcaacttcgtaacacgataaggaatgccctgtttggtcagctcttcttctgtcttacctacgccggccacttccggattggtgtagacaactcccggcacactgttataattcatccggtcttccactcctaaaatatgattgattgccacttccgcctcccgaattgccgtatgcgccaataaagaatagcctgtaatatcaccgcacgcatatactccgggatgagaagtctgaagatattcgtctactttaaccccattccgatgaagttctatattcagcttatccaatccgacattggtaatatttgctttacgccccacactgagcaagatcttttccgttttgatagtagaagccttcccatctttctctatgacgactccgtcaggtttcacttctattacttttgtattcaagtagaaagtgactccacgttttgcatattccatacgaagcatactgctggtttccttatccatgactcccagtatctccggcatcatctcgacaacatgcactttcactcccatactgttgaagaaagaagcaaactccattcctatgactccaccacctataacaaccaacgtttcaggaagctctttgatctccaaagcctcttttgacgtccagtaactaacttccgacagtcccggtatcggaggaataaccgtgtcggaaccggtacataccagcagatatttcacttcatatctttctccgtcacagatgatacggatcagcccgttttcttctccttctataaaggcttctttttccacgatcgtcactccgtaagagttcacagtcatctttaccccaccagtcagcattttcaccgttttctctttacggctcattattttagttaaatcaaacgaaggagattcggcagaaatgccatatttggaagcactcttgatgctatccagaattttagcagaatataacaacgttttagtaggaatacatccttcattcagacacaccccacctattgcctttttttcaaacaaaacggctctcagtccgtttgcccctgccctttcggcagctgtgtaaccagcagggccaccaccaataatagctatatcaaagttcataatcgtatctttttagtaataatacgattataacaaatgagagaagagattagttgtatgacagatcaatcatcctacttgatcgtcagctttttgagttcttctaatgtaccgttgaatacattgaggtctacatcttctttaataccgggtacatttccgacatcagtatgttgccagaaatcccacttaccctgatatttcaccgaatcgacataatagtgagcgatccaataaggataagcattgaaaatagaatcgtccagataacgggtcttgaacttataagaggtataaagaatgggcttcaccccataatgggattctatacggtccaaccagcgcttaatgccttgctgcaattcttttttctcttttcgtccggtcacttccacatcgagaaccggaggcaggtcgccggaatccagtttgaccgtacgtataaaaaagtccgcctgtttcaaagcatccgtaccgggaatatagaaatgataagcgccacgaataaagccatgattacgcgcattagcaaaattagtttgaaaggtagtatcgttatgatctcccccttccgtcgctttcataaaaatgaagtgcaaaggagttgccgtctgtttattctgtaaaagtctcccccagtctatttttccttgataatgggaaatatcaatcccatgaatatcatatccggaaggaatacaaactccatattcctttaaaccattacaaggtttccaccgataagcataaggacgtataaagaaataatagaaaaccatagagaaacaaccgacaattgccacagccaatatatttcgaagccaaccgggcatcgaataatgctgcttcaccggtgcctttttcggagcacgggaaggcctggaagaagaaaccgtcctcttttttggggtagtggaagcagttcttttcttttggacagcagaaatcggattattacgtgacgacatttactttgagtgatgaatgtaatatagataggcacggattacacggaatacacggttttaagaaatagtataactaaaaccgcgtcaatccgcgtaatccgtgcctgaaagagctcttcattgcaactgtttcttactacagtccggtgaagttttcttatttagcttgttccaattgcaaagtcttagttgcctggtcgcaaacttctgtaggaccaaagtactgaatcggacctggatatacataatccgtttcaacagcccaacggtcacgctgtgcagcgaatgctttgaaaggagcaccatccaatttcactaatgctttctggatcaccggtttcatttcaccgtggcggcgttccatattcatcatcatggtgataggcacaccacctgcaatccattcggcagcaggagcagttgtgttgcgtacagaagacatataaccggtcttaccgtcagcaatcagcatagaagctgtgtatcccaaagaatagcagtagtcagcatcaaagtttgacggagcagcgcaacgaccttcgtaaccgaagaagtggtgctgtgcagcaaacttacccacatatttgccatcttctttccaagcagccaatttggtagctaccatttcagacaacagtttttctgtttcgatcagtgatacctgaacgtttccgtgcgggtcacgatccagtgtcagctggcgagctacaccttccggcagacttgcatagatagcagagttttccggagacagcttacggatgatgtaatcacgttgatgagacttcttgatctgagagaactcttctgcatttgcagccaggaagtcgttcaattcagcgatcagacgcttcatagccggaataaattccaccaatccttccgggatcaatactgtaccgaagttatttccctgtgcagcacggtcagctaccactttagcgatagatgttactacatcatccagagacatatctttttcttccacttcttcagaaacgatacatacgttaggctgtacctgcaaagcacattccagtgcgatgtgagaagccgaacgacccatcaatttgataaagtgccagtatttacgggctgagttacagtcacgctggatgttaccgattacttctgcataagtcttacaagctgtatcgaaaccgaaagaagtttcaatcatatcgttcttcaagtcaccgtcaatcgtcttcgggcaaccgatcacctgtacaccgtacttcttggcagcatagtattcagccaatacacaagcgtttgtattagagtcatcaccaccgatgataaccagtgctttgatgcccaattctttgatgatctcaaatcccttttcaaactgagcttcagtttccagcttcgtacgtcccgaaccgatgatatcgaaaccacctgtgttacggtattcgtcaatgatgtcagcagtcagttccatatagttgtggtctaccagaccgccaggacccaagataaagccgtacagcttactttcaggattcagctttttgataccgtcgaacaaaccagagattacattgtgtccgcccggagcttgtccgccggaaaggattacacctacgttcatagcaggaagttgaacagcttcacccgcttcgaatgtaatcaacggcattccgtacgtgttagggaataatgctttgatagcttcctgatcggctacagattgagtagcagcacctgctacagctttaacggctcctgttgccaatgctttcggaagtttgggctgataagcagcccttgcgatttgcaatgcacttttagtcattttctttatttttatttaaaggtgttagtaagtttcttgtcaaacttgaaaagcgttgcaaatttcgcatttttcctcgaattatgaaagagaagccctcattttatttcgctgcatagttacagaggctattgcttccagccaccgccaagtgctttatacagttgtactacggtgatcagttcatcacgaatagcgttactcagaccaatttgtgcgtcaaaataaccacgctgggcatcgagaacatccaaataattgatcactccattgatatattgcaactgcgccaaatccatataactcttagccgaacgttccagattggcacgaagtgcgtacacctcttttatcttattaaagttgacaatcgcattacgtgtctctttgaaagccgtcaggactgttttctcataactatgtatttctgcttcataggccgcttttttgcctttcaacgcagcacggttctttccccagccaaatataggagtcaataaagcaccttccataacggcataaggcgattttagaagttctgacaaagacgtgctttcactaccgaaaccacccgtcagtgccagacgaggaaacatattcgtataagccacacctacttttgcattggcagcgatcagcttctgctctgcctgacgtatatcgggacggcgttccagcaaagtggaaggcatccctatcggaagagtttccgggaaattaaactcctgaagcaaacgggaacgggctatgcgattcgggtattctccggccagaaaagcaatatcattctctttcagcgatattttgcgttccagatcaggaaccagagtagctgtacgtgccaactctacctgcgcctgacgataagaagtctccgaagtaagtcctccttcaaaacggatacgtgccagacgaaccccttcttcacgagcttttaaagtctgcttgacgatatccagttccgtatccaaggcaaccagctcataatatgcctgtgccacttccgccacaatcgtcatctgaagcgcacgttgcgcttctactgactgcagatattcggcgatgctggcagaacgtgcccatcgcagatttccccaaagatcgagttcccatgaaacaaggaactgcgcttcaaaagtatccgatttcttaaaagcatctcctccatgattttcaagttcacgctcggcagtcactttacctttaatatcgggaagcagcgcggcagtggatatccgtttctgagctgccatttccttgatgcgggcagccgctatcaacatatctttattatgatccaacgcacggtctataagactgcggagtgtggaatccgtgtagatttcctcccaatcctgatctccaaagctgaccgtatcctgatgctgagccagactatcgggtaaatgaagatcaggacggacgtagctcttgcctactttgcaggaagtcagtattcctgcaaaaagtagtatagcaatatatagtttattcagtttcattatttcttatgttttaagattttcgactttgttttatacaccatcacaaagaagaacggcacgagaatgataccaaatacgatagcgaatatcattccgaagaatacgcccgtaccaatcgcctgtcggctcgccgaacccggaccactcgccagtaccatcggaagcattcccagtacaaatgcaagggaggtcatcagaataggacggaaacgtaatttcgctgcgtagattgccgactgaatcaaatcttcacctctatctacctgcactttggcaaactctacaatcaaaatggcattcttggcggcaagcccgacaagcattaccaatccgatctggaaataaacatcattctccagtccgcacacccagactcccagataggctcccaaagctgctacaggcaaggatagcaatacagcaatcggcactgtccaactttcatattgtgcggcaaggaagaggaagacaaacaagaacaccagtgccatgaccatccccgtctgaccgcctgcctgtttctcctgataagaaagtccgctccactccagtccgatattatccggaagatggtcacgggcgatctgctccataatctccattgcctgaccggaactgtatccctgcgcggcagcaccccggataacggcagtagtaaacatattgaaacgcttgatacttcccggccctgtcgtataagaagcattacccaaagatgtcagcggtaccatagctccattggaagctttcacaaagaacaggttgatattgtctttatgttcccgataaggagcttccgcctgaatatataccttatatatacggttgaacatattaaagtcattcacatacaccgaacctgtatacgctttcatcgtagaaaacacatctgccaagggtactcccagcattttcaccttgtctctgtccacatcaaagtaaagttggggaatctccgactgcaaggaagaagacaaacctgtaagctccttacgtttggaagcataatacatcaacgtatctgccgcatctaccaaattatcgaaagtagcctctccacgagcttccaactgcatttcaaaaccaccggagctgcccagtcccggtatgaccggaggagtagacaggtagactttacattcggggtattctctcaaatgtttttctaccgtatccataattttttcaatactggtgctctttctctcttcccagggtttcagaataacggtcaactcggcacgtccctgattactgcctacacgcggactgcttccggtcacgttctgcacatattctatatatggattcttctccagataagcaatcgcgcgttccgttactacacgggttcgctccaaggtagctccttccggcagttcaagttcaatcttaaagtatccctggtcttctaccggcaagaaactggtcggaataatccggtgaatcaacagaatagcaatcaataccataccaaaagcactcaaaacccgacgaggatgtttgatagtacgggtgacggcagctacatacttattgcttccgatacccagccactcattgatctttctgaatactatatttttcttcttgccactatccggtttcaaaatgagcgaacacatcacagggctcagcgttaaagcaaccacagtagaaatcagtacagataccacgatagttaccgtaaactgacgatacagctgcccggtaattccactcagaaaacttaccggaacaaacacagccgccaataccagtgaagtagcgatcaatgcgcttgataatccgttcatcgctttctttgtcgcctcatagggactcagcttctccgtttccataatatgctctactccttccaccactacaatcgcatcatcgaccacgataccgatggcgagaatcaaaccgagtaaggtcaatatattaatagagaaaccaaaaatcagcatgaatccgaaagtaccaatcagggagataggtaccgctaccaccggaatcaatgtagcacgccagctctgcaaagacagatacactaccaacacaaccagcaccaatgcttcgaacaacgtcttatatacctcatgaatagactcagagatatacgttgtcatatcaaacggaatctcataactcaatccttccggaaaattctcgctgatttcttccatcgccttctttacattctcggctacttccatcgcattggcacccggcaacatgtaaatacccagtaccgctgcattctcaccattgataccactctcggtattgtatgaagaagcctccagagatacacgtgccacatccttcagccggatgatggaaccattggcattggcacgtaccacaatatcctcaaattgccctactgtagaaagacgtccctgagtagtgataggaatcgttatatccagtccctgtaccggctgctgacctaatacaccggctgccgattcacggttctggtctttcaaggcattctgcaagtcctgcacagtcaatccgaagttagccagcttatcaggctctgcccatatctgcatagcatagtaacggctaccaatattggatacacgtcctactcccggaatacggcgaatcacatcgagcacattgatcgtagcaaagttgctcaggtaaatttcgtcaaacttaggatcggtagaagtcagacagagtgtcattaactgactgggtgcctgtttctctacggaaataccattctgaatcacttccgccggaagacgggattcagccagcttcacacggttctgaatttccacagcagccaaatccgggtcagcagatacatcaaaggtaactgttgccgagaagccaccggagttagaactgtttgattccatataaagcataccgggcgtaccattgatttcctgttcaatcggagtagccaccgcctgcgacacggtaagtgcactcgcacccggataagacgcactgatctttaccaccggaggcgtgatctgcggatattgatccaccggaagcatggtcagcccgatgattccgacaatcacaatcacgatggaaatgacagccgaaaataccggcctgtctataaaaaaactaactttcattgattattctccttttgcgttatccttcattcctgttgtagaatcacctgccaccatagtggtatccttcacctccgcttccggctgactgatccgtactttcatgcccggggtcaacttatggaaaccttctacaacaattgtctctcctacagcaagtcctctttccactacgacgttattccccacttcgggtcctaactcaataaaacgtttctctactgtatcatctttacgcattgtataaatataagctccgcctttttcaatggtaacagctttcatcggaacaaggatagctccttcacgcacgtccaaaagtagttttactttggtaaactgtcccggaagcaatacctgtttcgggttaggcatctctgcacgtacggagaaagtacctgtctggggatcgacctgcggttctgcaaaatcgacatatcctttataggggtaaaccgtattatccgccaaagtaatagttatgttcggttgccaggaacgggtagaatcctgttgtccgaggttaatattacgttctttacttttcagataatcaagtgccgtcatactgaaatcgaccaatacggtatcgctttttactactgtagccagcagagactttcctccgggacctaccagcgttcccaagtctacatttctttcactgatatgtccggcaagaggtgaacgaacaatggtatagcctaattcgagttcagcctgcgccaagtccgcctcactcatcgctactgtcgcaacagcgctttcataagctgcttccgcattatccagatccagctggctagcagcattttgttcgtacaacggacggatacgtttcaagtcacgttcagctttcaatgcctgtgcttcgtcctttttcagctgagcccgtgccttgtcggctttcgcacgatattggtcctgattgatcacaaacaagacctgattcttatttacataagtgccttcggcaaaaagcatgttttccagatagccttctaccctggcacgtacttcgacaaattgctgggcacggattcgccccacatattctccgaatatctctacatcatcttttataaccggttcaacaatcactgtcggcatttccggcgcagccttctgaggtcgagtcagtatccaatatactcccaacacaattaccacacatactacagcagcaatgtttctctttctcctcagtttcaactcatgtttcgaaaagaataatctcatatcgaatcttattatttaatttaacttatgtttgttctacactctattatgcaatacacataccaaaatatcctgttttatcttatctgtttattatcaacatattacatttttcctcttgaagacggaagtgtggaaaacatccttaaagtgtagaatttatccacatttccgacttttagaacattttttatagttcttgtttcatcaactaaacaatttatcccctacatttgtagttatattgtacatcaacacaataacatgtctaatgaaaaaacaaatcttttcaacattagtttttgcaatgtgcctgatattacctttttctgtttattcacaggaacaacggaagaaggtcggcgttgtcctcagtggcggcggtgccaaaggagtggcacatatcaaagcattgaaagtcatcgaggaagcaggcattccgatcgattatatagtaggcaccagtatgggatctatagtcggtggactttacgccatcggttatactccggaacaactggacagtatggtacgcaaacaggactggactttccttttgagcgatcgtatcaaacgcagtgccatgtcgctcaccgaacgcgaacgctctgcaaaatacattgtttcgcttcctttcacaaagaacccgaaagctgccatgtccggaggaattatcaaaggacagaatcttgccaatctgttctctgatctgacagtgggctaccatgactcgatcaattttaataagttaccgatccccttcgcctgtgtatcggccaatgtagtcaatggggaccagatcgtattccatgatggcgtactctctactgccatgcgtgccagtatggctatccccggtgtattcacaccggtacgcaaagacagtatggtattggtagacggtggaattgtcaataattatccggcagatgtggccaaagcaatgggggccgatattattatcggagtcgatgttcagaatgcgctgaaaagtgccgacaagctcaacagcgctccggacatattggggcagattgttgatctcacttgccagaccaatcatgaaaagaatgtagaactcactgatacctatatcaaggtaaatgtagacggattttcttccgccagcttcactccggcagccatcgattccctgatgcgtcggggcgaagaagccgcacgtgcacagtggaattccctgattgccttaaaaaaagaaatcggtataccggacaattatgtccccaaacaacatggaccgtactcttctctttccaattcacggacagtatacgtcacagatatatccttctccggcgtagaggctgatgacaaaaaatggctgatgaagaagtgtaatctcaaagagaacagtaacattaccactcagcagatagaacaagctgtgtatcagttgcgtggcagtcattcttactcaagcgccagctacacacttaccgacactcccgaagggtatcaccttaatttcttgttagaagaaaaatatgagaaaagaatcaatctgggcatccgtttcgactcggaagaaatagcatccctgctgattaatgccacagcagatctcaaaactcatattccttcccgattatccctgaccggccgattaggaaagcgatatgccgcccgcatcgattacacactcgaaccgatgcagcaacgcaatttcaatttctcatatatgtttcaatataatgacatcaacatctatgatgaaggtgaacgtgcttacaacactacttacaagtatcatttagctgaatttggtttttcggatgtctggtacaaaaacctccgcttcggactcggacttcgtttcgaatattataaatacaaagattttcttttcaagaaaccggaactcactgggctggatgtagaatccgaacacttcctgagttatttcgctcaggtacactatagtacattcgacaagggatatttcccttccaaaggaaccgaattcaaagctgcctattcgctttataccgataatatggcgcagtataatgatcatgccccattctctgcgttgagcggctcgtggtccagtgtcatacctgttacccgacgtttttccattatcccatccatctatggccgtgttctgattggaaaagacatcgcctatcccttgcaaaatgccattggcggcgaagtatacggactctacattccacagcaactgccgtttgccggtgtgaccaatatggaactgatggacaattcaatcatgattgcatccgtgaagctcagacaacggatgggaagcattcattatctcactctgacaggtaattatggcttgacggacagtcacttcttcgaaatactgaaagggaaacaactgtttggtatcagtgccggatatggtatggacagtatgttcggtccgttggagattacgttcgggtattccaatcagactgacaaaggaagttgttatgtgaatctgggatactacttctaagtcactatttcggttcctgcatacataggactatacttaccatgatgagaaaaagttctcactgcgatgagacttttttctcatcatagtgagaattttttctcatcgcagcaagaaccattgagaatattcagtatcctaatctgctgttatacaaaattttcccttttctgtagatatagtaatccgatcatcatccagactaaactggcggataaaaggaaaatgcggtttttgataaggattccctcccaaataatcggatgaacattatcgggaacacgaaaaggattcagcagaacgttccaaaaagaatccggcttacctaagaacatcaatgcaatgcctataataatcataaatacggcagttccgtttccactccgcgtaatggtagacagcataaaagccatgtttccgaaaaagagtatcgggaacatcaactgtaatgccatctcaagcggattgaccggatacagcaataaaatggctatgtatgaaaagataatcagaataacaaaaattgccacataaatcatcaataaccgcacgccccaaaccttatacttatagtcggggattccaaagagaatctccaatatccggctatcttcatcattctgaatgccgaatacagccggatagaaaataagcagcatagacggaaacatcaggatgctatagatgagtccctcgttaatctcctcccgtttccacgcattctgaaacataaaaagagcaaaaaagccaaatgcagccaacagaaaccagaaaaacttcccggcaaatataatcttcaggttatacctgactactttaggcaacagttgtatcaattgtttgaatgtcatatccttcttttctttttaattcatattcttcagcagacagagataagcgtcttccaaattagcttctacctctacagccccttcataaggctgtccgacagaaagatagcgcacccgaatcgtatcgccttcctgaatatgatgtattaccaacgatttgtccagtactttttcaaattctgtcttatctatattaaactgccatacttttccgttagccatttccaccatatccgaaggatcaccgaaatatttcagttcacctttattgattaccactacctgattacaggaactggatatatcctcaatgatatgagtggagaaaataacgatgcggtctttactcaattccaccagcaaattacggaaacggatacgttcgcgagggtcgagtcccgctgtaggctcatccactaccaggatacgtggtaaatgaagcagaataagcgcaatgccaatacgctgtttcatacctcctgagaaagaaccgatcttttcgtctttccgctcgtacatatgtaccgctttcagcacatagtccagacgctccctgcgcaaatctccatctacgattcctttcaatatggcctgataatccagaaactcccacgaagtcatattctcataagttccgaattcctgcggaaggaaacctatcagactctgtagttcttctctgtagatacgggtatccagaccattgatccagatactaccatagctctgctcaaagataccacagatgacacgcatcaaggtcgatttacctgccccattgggtcccagtagtccgaacatacctgtctgaatctcgaatgacaccccacgcaatgctttgaaaggtttgcgtcgttttccaatcataggaacactcttcaccatgcggaaataggaacggcgaagccctgcaaatcgtccggtgacacgctctatatttacatcgtgatcatacagatactgagaagtgacatagatggcaatacccaccagccataacaatccgatcatgatgaccagcccgttattatccagtttccggaataactgaaacaggataaggggaggaagactccagaatatcacccggtttacgatctttgttacccgattatctccgtatcgataatataaataggaacgtacctttctccacaaatacagtaccgctgcataaatagcgaacgagaacaggaatatccaaagcctgttatgaatgaagaaataggtgaaataaatggcaaacagtaagataccaaactgccatagcacattgataaagtccttcagagaatggtattcattgctcaatcccagacgtttgcgtaattgcaaaccactgttccactgacggctgatgtgtccaggccaatcgtagatcttaaccagattgcggacagaaatacgtatttcttcatccggattgataacctccgccttagctctacggagactggtttgcgcaaagtatgtcatccccggtatgcctgcaatcagtgctaccagatagattgactgccaaagcattccgtcagtgtatagccagatacagattacaccggacacaaaaagaatcaggtgaatggtccatagtttacgggataacgaacggtaccactgaagcacattttccagtcccatacaaactgtcggaattaaaatcagcgtcagcatggcagaaaagaaaagtccgcctatcactgtaatggcaaaaggtgcaccgatagcccctgcatactccgtatctcccatagccaacggaagcatggcagcaatcgtggtgatggaagtaatcagaatgggacgaatacgtgacataccggcagtcatcaacgccctgttccggcggtatccccgtttacgcaaaatgttggcgtaatctatcagaatgattccgttattgacgactactcccaacagaataaggaaccctgtcagtgtattcgcattcatcagactgttgctcgaaagcaataatgccagcaaagaaccgatagcggccaacggaatggtaaaaagcaacacaaaaggcgtcactacagactcgaagactgaagcaaggatcataaatatcaaaagaaaagctgccagaataaggaatttgaaatccccgaattcatcctcctcatggaatacctgcacagcgactccggacggaagattataactggcaatcaactggtcgatatcggaacgatatcctcccaataaatctttcgaagactgaacatctctcggaaaagcatagtatacctcaatctgcttatcttgattgacacggatgatgcgcgaacgcccacgtccataattcagagacgatatatcttctagattgtgcataccgccattggcattttctatccggatagcacgcaagtcatccacagttttctctttctgagctttttcctgtgcctcttcttcagtttccttttccggtatttcgtcacggataataatatcataaatatcctctcccaccttgaaagtagcttcggaagagtattcattattaagcgcagtcaatccggtggtaatattgccacggttaatatcataagcagtcagcagaatagggtcaaagttcagatttatttctgcctgacggggagtatacgaaacatgagtatgctgtacaaaatcctgttcgtccaacaaataacgcacttcctctgccaccatctgcatcatttcgaaatcagatcccctgatcaccacccgttcactgttgtcaccgatacccaacaaacgcatgaatccgcccagactgctcagagccgagttatctcctccgcctcccatagcatcagagacatagatttccgcaccattgatattggcgactttagtctgcacatccgcttttatatcggctattttccgtttggcgatctttgtgtaatcttcctgcaaaacgagtgtcagagtcgcctctttttcccgaatacggcaaatcagatctttcttttccggaaaatcctccagacgttcttccagtacctttacaatcttatccgtattttcaagcgtactcccggtaggcatcacgacactgatgttgaaccggtctgaagcaacttccttcatctgttgcacattcaaggtcaatgacaaaatcaatgttgcaaaaagcaagattacagctccaaagactgtcactcccggattacgcatacaagtcttcaataagaccagatagacctgcatcggacgctgaacgatcgagactttttcataaacgacgctgttcccactcttactcttcaaaagaaggtaagtaatcatcggtataaaaagtaaagctacaaacagcgagatcgtcaaagttgatataatggatactccgatatggtgcccgatcagttttatcaggaaattatcagaaaaaacgaacggcaggaacacagtaatggtagtcagggtagccgccacaatggagcgccacacttcttttgttccctgcgttaccgaacgttcgggcgtatagccgtttcccgacaaacgataaatattctcaagcaccacgacactattatccagcagcattccgatggccaacgccattcctaccaaggtaagactattgatagtgataccaaaagcgtagaagaagttgaaagccgtatagacagaaatcggtatggaaagtgcgataaaaaacaccaaccgcatattcttcaggaaaagccaaagaacgaacacagccaataatccccctaccaatgccagattaataatctggttgatattattttccatggtttcagccttgttctcctgaatgacaatttccagttcgagcggagccagcttctcattcagcttttcaatcacatcggatacacggtgtgaaagttcaatcagattagcctgtgaatcattgatcaaagcaaccgaaacggcttcttttccattcacacgactataggtggtttcatctttcaagtcaaaaaagacggttgccaggtctttcagcagaataggaccaggagcgacaactatattctccaaatcagaaactttggtatacatcgcattgacatggacaaaattcttgctgtcgggttcatctgcgaagcctacaaatgtcttttcctgggtattctgcgagagcaaaccgcttattttggaagcagtgaggttcaaagccttgcaagcctccggattcagacgcacttcaatggctttctgccgtcctccgtagatattgacggaagctaccccatctatattctccagatcggaacgaacatcctcgtctaccagactccggacacggtcggttcctcccgtaccacgcacttgaagcaccatgaagttattattcatctgagcaatatccactttctgtacctgtacggtaaaaccggtcggcagggaggctgcgatttcattcactttctcctgcagtttaagactggtcatcttgaagttgatattctttttaaagtcaatctgtatgctggactgcctcctgtcaatgtaggattgcagtttgtctactccacctatcgcactgaccgctccttcgagtggaataatcacttccgactctacatacgaagggtccatatcctgctgtgacgacacctggacaaacagaaccggaagttctgcgttgggcagcaactccaccggaagttgtttatacgacacatagcccagcaggctgagtgcaataaacagcatacaaatcgttattctcctatttagtaaaaagttcatcttcagctgtttttagttcggcgatttatacgtcttttgatattctccaagacataatagacacaaggaataaccatcaaactcatcagagtagaagttatcaatcctccgatcacagctatagccatcggtgaacgtaaagatgcaccttcaccaaaactgaatgtcatcggaagcatggccagaatcgtagtcaaagtagtcatgatgatcggacggatacgctgttgccctgcttctacaatggcatcagtcaactccattcccgcctgactaagctgattgatacggtctaccagaatgatagagttattgacggcaatacctcccagcatgacaataccgataactcccatcatattgatagtggttccggtaatgaagaaaagtaagatagcacctactacagccagaggaatagtcagcaagatcgtaaacggatgcagcaaggattcaaactgggaagccatcaccatatagacaagtacaacagaaagcatcagagcaaacaacagactgttcattgattcttgccgtttttcttcctctcctgtcactgtaatactgtagttagcaggcaattcaatacctttcaccgtttcacgcacttcggctgctactttatccagtgatttactcgcatccatattagccatcaccttaccgatacggctttgattgcggcgcagaatctccttgggcgcttgtccgtgagtaatggtaacaatctcttgtaatacaaattcctgtgttccacttttgatgacaagagcaccaagagaactcaacgggatatccggcacctttatgacgatatcacgcatctcaccgcgatattccatcttaccgacttccttaccgcttagttgctgcttcaattgttcgattaccatagccacactcaaattattgataccggctattgtacgatcaatcgagatcacaacttccggagcaccgtcttccacggaggtaataacatcatagattccatttacgccaatcatccgttccttcacctcttcagtcaactgagcaatctcatccaactcctctcctttgacctccacaacaataggagccccttcgcttcctaacagtgaactcagagaattctcatcctgctgaatcgtcagttccagtccgtcaggattcttggccgattccacgaaagacgcaatcaccttttccggtgaaagtgtacattccggtgaaaggatcactttcatcattgctgtattttctccttcaaatatcgcattttccgaaccgctcccctctccgatatgactgtataccgtacataaagaatcaccgccaacgatagcatataacaattcttccagattacctacagcagcggaagtgcgttccatctgtgtaccttcgggcattttgattacagccgtaaacgtcttgctttccgcacggggcataaactcagttccgataaacggagtcagcaatccagtcacgataaggagtaacactgccataccgatcaccagccaacgtcgctgaatcagcttgcgaagcactctgctatatcctgtaatacgaatggacttcacttcttccagcttaaccttcttgccggaaagctggatatataacatcggaatcaccaggatagccacaaacaaagaagaaaccagtgagaaagtaaccgtccatgcctgatctttaaacagttcgcccgaagctccgtgaagataaacaatcggcaggaagacgacaatagtcgtcagagtagaagctattaccgcattggcaacttctgccgtcccgttaatagcagcctctttgatactcaatcctttctcctgatttcggaagatactttctatgacgacaatggcattatcgacgagcatacccgccccgagcgccagtcctcccaatgtcataatattcagtgacagtccgttgaagaacatcagattgaaagtagccacaatcgagatgggaatagcaagactgacaatcagtgttgtccccatccggcgaaggaatacaaacaagactacaatagcgagaataacacccagaacagcactgctcttcacttctcctatcgcactttttataaaagtaccctgattggaaatcacctgaaaatgataaccgggcaatgcattctctatcactgccaattggcgggttacctcatccaccacttttacagtattaaagcgcatctccttataaatagacagtccgatactacgcttcccgttaatccgtacaatgttctccggacgagcgttcaaaaactgcacagtagccacttccttcaaaaaaacaggagctttattactgttggcagtcgctgttcccgaagcattgtttccggatgcttcctcttgttgtatcgctttgtatccgacaatcagattctcaaaatcatcttccgaagcaaacaagctcgaacttttcaccagatattgtaatcccagttcactgacccgtccaccggatatactctgattattcgattcgatgcgcgaagcgatatcttctattttcagttgaaaagcatccagtttataaggatcagtctgaatggtaagagtactgacttcttctcccgaaagcgtcacttcagccacgccttccagacgaatcaactcattgcggatatagctttcggcgattttccttaattccgccatatctgtaatactctgatgagacattcccaccaaaactaccggagacaagttcgcatcgtgttgcgtaatcttcagttcagtaatatccttgttctgggcaaacggattcatggctttctgcaaatctagaaaagcctcatccatatcctttgtccaggtatattctacagtaattcgtgccgtcccggctttaatcacggaagagacctgagtaacatcactctgccggatcgccatagactccatatttttaacgaattgcttttcgatctcctcgggagggcgttcacccgcctttaattcaataaacaggcggggattattcagatcgggcaataaatccacactcaactgatcgtatgatacttttcccaacaataagagggcaaatactaccatacaaatcgtaaccggattgcctactgcaaatttgattatattcttcataagtatttcctattttcaaaagatgcgttcatatatcgcatccatgatttacttttggattttgactttggcgtcttctttcagtgtttcaaaacccttcactaccaaattgtcatttacattaagtccggatagaatttcgatattatattcatcctccagacctgtttgcagattgcgtatctttgccgtattcttttcgacgatatatacgtatttccggcgacgattggacaagattacgtctttaggtataatgatagaactatcagctctgtcaacgataatatctgctttggcgaacatacccggacgcaacttcaactggtcattatcaatcagaatctttcctttaaaagtacgtgtctccgtactgattgcaggagacagctcaccgactctcgcttttaaagtatctccagggatggtataatgagtaatatataccggttgcgcttccttgacataacgaatgctgctttccggcagattgatatccatatacattttatcataagccatcagactcaccatagcctttccctgctccactcttgtatcggccgtatagtgaggcaaatcaacaatcacaccatcaaacggagctttcactttcatcttctccagattgagttttgcgttttcataatcgtaacgggcattcgttacttttacttccgtattccgcatttcactcatcgtcacccctcctttttcatagagagctttctgctttgactgttcctgttcagcaatttcaagacttagttttttagcgtcaatagcgattccgttttcatactccttgtcttccagacggattatcagttcccccttacttaccctgtctcccattttgaaaggttttccggttctcggattagtctgaagtttataaaatccgctcatttccgcattctgagatgcaccgtaagtcggctgcactgttcctgttgtatttattaatttactgatagaacctttcttcagctccacgacagataccggagttgcaatattattgggtgcgttttgtggtttgttgccacagccggttaacaataaggttgttaacaaagaagatgcaataaaaatttgatactgtttcatggtctgcttattttttatcaataatgtctttcataggaacaagagggatattcttgtcgaaatcatacaatgaaaggattttaagattaagtaattctattctgtaattaatcaacgcctgcgtataagtaatcttcttattcgaaagctgagtctggaactggctcatttccataccggttatgtcaccttcccggtaacgagtctgattcagatcataggtcaactgtgcattctgtacattttgctcggcgatcttaatctgagtccggaggttttcgaggttacgccatacctgacgaatattcagctcgatatccactttatcctcttgaaactcgagttcattaatccgttgagccatcttttgtgctttaatccttgctttcttttcaccccagtcgaaaatagggacagcaaagctgatggaaaccctcggattctgtgtcggattattatagactttattcaggtggctattatctcctatcaatccgaaagagatggatacatctcctttaaactcgttcagcgcttttgtcttaatcatatcgaactcaagttccttgctctctatttcacgctgacgaagttccagacgcgaacccaatccatgcgatatggcctggtccagatttacctgaatcggtttaatctccacttccgcaaatacgagaatatcttcatccagcctcattccgagagtctgtttgagtttgtctttcgcattctccagattcacctgactttcgtctacagacgaacgtgccgtagccagattcagttccgcttgaaagagttcgtccttcgctgctaaatccgcttctaccttattcttgataatatcataactttgctgggcattaaccagttcttcacgactgatttccagattactctgtgccatatagacagaatagaactgatcggttatacttttctccgtattcagttgctgcaaagcataactgatattggcattttcataatcatattctatttgcttcagttccattttacgcttgttgtatgtaaaaataggctgagtcaattgcagatagaggtcattgctgaatgcccggttactagttttatcgccttctataatggaactgttgtcctgccagccgaaacggttgattaaagaaatagtaccgtctgtccatagaatgggctgatcgacctgaaaggtcccgctggtattgaatgtttcattcgtgtaccattgtgacagacgattatcgaaacgcctgttcttgttatagtccaccgggttcagatttaatgaaaatcgagactttaatgaagccttctgcgccagcagattctgcttatatctctccaaattcatgtaggaacggcgaagagaaggactgttctcctgcgcaatctccattgccttgtcaatcgttaaaggaatttgtccttgtgatgtcagggcaattcccgtaaaagttacgattgtcagcagcattctttttaatagtagtaagtcactttgcatatagtttgctgttttaataattatcgtttcactattttcactgcgtcggctgtcacagagcgcagcttacattcatccgtcagcacgacacgaaccgtatcggcactaaaatagtaagtaccgagttgttcccaaccctcattggcttttctcagattgatataggcatcttccatctcactgtcgtatgccaccctgaaatgatattcaccctgaaggcgatcattccatcgcagttcatcatccttgaatacatgataataaagctcatattgaccggcttccggcacaggaattttccatgtagccgtctgactgccgtctccactcttaatcacataggccgaacggatatatttgccatagtatttagcattggtggtagctgtccattgtaaaggcgcacgccaccaggatatgcccgaatatttaaaggaagtatcctccactttatccagccatttaggcagaagtcctacgacagcaggggtagaaagtacaaagagagtggaatcttcattatccacaataacctctcccggcatttctaaggatgattccggcaaggtatagatagtgtccttgactattttattccgttcttgttttacattaccaatggattgccgtatcatataaggaagattgccggaaaccatcgtattgatttccacatcacgtatctgttcttcccagacagaaacaaattctttgcttgtatgggcagctatctctaccttttttctggctctaggatcttccatcggttgataccaccagccattttgaagaacgttcatctgaatgattccgtcataatccgagttattgctcaccagtactttcaagacaaagaattcttctcctcctttattgacaactttggtcagttcgggctctccgatcgaataaaaaggaagaggcgtcaactgttcccattctttcaaatatgaataaagatccgtccggctcatttctcccagagtatccagcatattttcgaactttatgttcagaaatgtattacgcttcaacatcgcatatagtgaatcccggaaagcatctacgcccatgtttatttctgaccgggcaaaaagacggcttgcctccagtcctacgatattattttgcagattacgctgttccacatcagccagcaactccttgaacgtatgcttttccagcagcaggttggccttttcattgttactaagcccatttatctgacgttcccacccttcattttccgacttcttttgcagatatagctcaatagcacgattggcaacaggccattccgaagagtaaatattgtaccggaaattataaatctgcgggaaaaggaaataaggatttgccgtagacgaaagatttccccgtcctctactacccgacgaaaagttataatcgccttctgtctgcaaaaacatccaggcaaagttactaaaagtccgcatctgggcttcctgcagactgatttcattatttcccgaccaccggatatgattcttcacctgcctcttcacatccagttcccagaatatagctcctttttcggggaacaataccatttcaggttgtactgtctcctgcgcttgcgaccaggcacgttcatagctggcaaattgcacaggaacttctacaatagaaaatcgcttaaaaggataatccagtttatattgccgtgccagttgctctttcacattacgtatcagccagggaatggtatcgtgaatagaatcaaacgaagcagtaaaatagtcatggtcccttaaatgccaaacgctataaagaatgctgtccgcataagcacttttttgctgatagtcacctatgaccaacgatagtgtctgagacggataatctcctttaaacgaatacactccttcttcatcacactttccttccccttgagaaagaggaactaaccccggtagaggcttgaccttcaagcgataattactgaaataagtttgctgccagtcaggatttttatcactatagcttgttcctgcacggggataccaataagtttcaggggtaagcatcagataatttttcgtctgaaaactatactgcttgtctatgttgaacagaaactttttattggaagcttgcagcacttcgggaggaatatccaaataacaaaatgagttatctatctgtccgtcatacctgaatgttgcagagattgtatcgcctttggcatgcttcgtgccgaaatccaccaatactatttgcttgtcacgtttaaacttgagttgctgtccggccgaatgaacggaatgaatggttaatcccggattcaaacagaaggtgaatacggcagatgagtccaatgccactcctttcacagttacttccgacagaaaatcttcaagatgctgctctacagaaagatcatattcatgaatgaacatcttcggagtagaaacatattggttgttgatcttcgtataggtagcgcgtatatcactttgatataaaatcgaatgtatatgccaataaccgcatacgaaagctaacatgagagtacaaaaagaaataaccagccacggataattactgtgcgatgaattcggcagacgcctgaacagggaaatcgtgaaaaagacaaacgccagtccggcaagaaaatagatgccacgatgatttaaaatcacctcccagttggaaaaaccgacaatgctggacttcaccaaaggaagactataagccatataatcgaaaagataataaaacttatcttcaatatagaaaacggtaagtccgatatatcctaacaataaaacgaatgtcagtgcctgatttttcaataccagcatcagaaagatagccaggccaataatgaaaatcagcgtagggacactgatcaacagaaaataaagcaagtaagccatccagtccacttctcccaatgtcaggttgaatgcagccgtaatagccataataatgagattcagcaacaaaaagacgcgcagatttccccaaatcttaccgatgacgtattcagcattacttaatggacggacataaaagacttctgatgtatccagctttttatctcttttcaggaagtcggatgccagaaagatagcaataacagcctgccctgtatttagcaacagtaaaattagataaggaatgttcgatggaatggctgtagcaatccagaagcctccgctatcttccgatacgaacaactggaaattgaaaaaagtaatgatagttacagcgagtaccgtgaatactctgaagaaccagcttctgattaataatttactttcatattttgctaccgattgtatattagatataaaggtcatatcagcatatcgtgtttagtcgtttgtccaaaggtttaattgattctccatataatatacataggcgtgttccagattagggggaaatggttccgcttcgtatccttctacttcatcggcaaccacctgtacttcccagattgtccccgatggaatcgtggagattaccggatattttttatcgatctcatgcaactgatctcccgcagccctaattctccacactttgccctcggctaatttcagcatatcttgcggagaaccgttgaaggaaacttgtccccggttcattaacgccatattattacaagtactggaaatatcaccgacaatgtgagtagacaaaataatagtcacatcattctcgctgacctctgaaagaaggttacggaaacggatacgttcttccgggtcaagtccggtagtaggttcatcaacaatgattaccttaggatgatgtatcagcgcttgtgcaattcctaaccgccgcttcatacctcccgataatttattggcatatcgttcgcgaacatcgaacaacccaacgttttcgagcatttcatccacagcctgttttctctgcctgctatgggtcataccggacaaacgcgccgcgtaatcaagaaactcatacgttttgtatttggcaaaaaaacgaaagtcctgaggaagataccccagaataccgcgtatttctttccgctgtttcatcaaatcataaccgcaaatttctacttgcccggaagttggttccataagggctacaagaatacgcattaaagtagatttgccggcgccattgggtcctaataagccaaacatccctgcaggtatttccagattgacatctttcaaggcatgatttccgtttggatagatcttattaaggttcttaataattatgctcatgacattttatttgtcctatgttgtattgggtgataaagataggctttatttacaggatacaaatcataattataaacattaacttatattagtagaattctgtctaaaatgaacattcaacaaacatccatatatctcataaacgaaaaggaagaaaccacttcacagtgacctcttcctcctcatatcccatatgattattgcccaacagggtttataaaaaaggggtttattaaaaaagggttatttttatgatcttaattatttattagttacttccacccttaccaccactatgagtaggattagtagtcactgtcttatactgatggtcagttccggtatagcgtgttgcagttactgaaatcttcacatccttattattatacttcactgtggtcgacaatgtagtagtacgagtcttggcatagcaagtataagtcattgttgtataaccgttcacatttacagtattataggtacgagttgtttctgtaatacctgatgccgatcccatcaatgagtataaacgagttttgaagaaagctaccatagcattaactgtttctggttttgcacctgacaaagctttttctacagccgctttaatatccgcatctttacattcccaacccgacttttctttataagtcaatgcaattcctgttacagctttaggattttcactgttatcacaacttgcctgtcctaaaatctcactcttcactacattttcagtactaactttactagtgactttattttccatagcataggaagagaaatgcttaactttagttgtgtagctacctgatttctcatcataaacaactttattaatgtcctctgtttgtggaacccactttccattctccaaataagtaagtaccatatcatcagcgaaagtcaagccaggaataggattaggaattgaaatagttggatagtggtcttttgcaaatgtcaaaccactaggttcaaagtgtgctgccgccaaaggtatggtcttttctacttctttattctcttcttctttcttcacttctgtagtcacagtttctggggctggtacatacgtagttacactgacttcagcattaccaccttccagaacgtcttcattaccttctgtctgaattgccccagctgggatttctaattcaggagttacaagaggaagatcttctttcacatcctccggttcaacagtacccggttctttaacttcctcattcgaagcactcttatcttctaccttaacctcttctgtattaccagtctctccaacttctacagtcgtaggttcactttgcttagtcaaagccacagcaacagtcaccacactacgattttccgcattagcagcaatttctacagaagtactttgagcaagataacctttaggagcaacttctacagaatacttacctacattcttctctgttacagagaacttaccatctttgtcagtcttaattgtctcagtaccaatttttacatcaacaccagacacacctttcccggcatccgtcacagtacccataatataatactcaacaaccggagcgggagtttcaatcacttcacctggttcttgctttggttcatcgtcatcatcatgacaggaaactgttacaaaagacaacacaccgaaggctatcgccaaagagcatgcatacaaccattttaaatttctcataattgttcaatttttgtttaaattactaatatcaactcttatttaagttttgtcttttcattggtacgaatcaaacaataacggatataatccggctgccagaaacggctgttttcagcagatttcggttcggttctatagcttacccccaaagcacggcgagcaaattcattcccactacgcatgtcatattgaaaagcgaaataatccggaagcatcacacgtaccgcgtgacgactacgcttcttacccggcaatggaatcgaaaaatgaaatccggcatttgtttctccatctgtatacatgccataaagtcccacgacatattcaccgaagtaacgtgaaagaattccgcataccccataatctccatatataaaacgtccaccgctaactttcaattgagtattcacttgtggaatgaaataacctacgctgagctgcccattcactcttttccatttactcattccccagtcgttgccatataaatgagacgaaccggttataccaccttctccttctactgtccaacggccgtcagaagaaaaataaccaataccggctgcgagtccctgacgatcatccgagaaatttccaccagtcaggtatcccttccaatgattatccagacgaaattcctgacgcaatgtcaaataccccagtcggatacaatcccatttgcccggctcattattgacgataggtaagcaaacctgcagcctcaatgaagcacctttccaaagttgcatttctacagccggttgcaattcaaaagctgctttatataatttgtaagtaacattattaactaacattacccccggataaaccactacgtccactttcccaaaagtagtagactctcgtttggttccttttaaggcctccattgcagttttggtggaagtagtcatctgcatactacagtaaactccatccaaatcacattttcccgattgataatcctcaatcagcttcgcaggcaaagtgatacaaagttgcggcaaagcattatccaatatgaccaactgcaatgtagagacttccggaagagtgatcaggcgacgtattgcaatgcctataccattataagatcccctatatacggaagtctcaaatgctgccgtaatcgtatcctgcttctgtgccacagatatattttccatttgcaattctttcaggacttcagatatcccagcagattgcgcgtccacactttccaaagtgcagcaacatattatatatagtatactaaatactcttttcatcttcttaatgtattaatgtacattcataacgcaaaccggcagaaacacaggtaaattcgcgcgtaaacacatggacggacaaacgtttccaaaaacgtattgctccacccaaattccatccattggtatcatactctgccatcagctttaactcacggcaaaaagcgggagtataacgaataccaccaaaagggcctttcttgaaagccggttgattgccctgatgaaaataccagcctgctgtaacagccaactgatgccccttgcagaaaccaaacgtcttagttaagacaccataataatctccccaatactgagtagccttttctgtaaaaagatcatcagcaccaattaccacagcagggaaataacggctttctttcaatggacggatacggatagtattggaacgatcttggttgtgataaccgactctgccattatacgttcgcattttgagtaacgtcatacggtaagtcagttcaacaaaagagaacaaagacatatctaccgagtagttcatggtaggatagttaaacttattaggcgtaacctcttcaggaagaaagtttgcgcttcccataaaggttcctgtttcctgcatctcggctgtaggtatcatcatctgcccagttgccccaagagcatattgtgcatgaacccggcttgttgtcaagatgagaatcagaattaatacaacaccctttaatggaataaatcgcatatcccccaaaatagcttcagtttgtttcattttttatctatgtatattcctaaatagagaccttaccccaatttgattcataaatcctctatttttaccattcttttttctgttacttcttaggtaacggaaaacacaggggaagggagaaatctcttaaaacacgaaaaataggacataccaagttgctaaaggaggctcagtctaagcgtagggtgaaattcctttgattatgggacgtaaaaatcttagaatatgaagaaaagggttctttcatgttctaggctatttttatcttatttttaaatcaaaaaagaaaaaaaggatagtttatttgcttgttatttatttttttgtctatctttgcgccattattatttccgttacctaagaagtaacacacacatatatatactgattactaatactttatattatttacacttttctccaagcaattcttcacgtaagataaattcattctatttacttcagtacgttctttcaaagcaaagcctttaagatagatttgtgttgttttgattgatttgtgtcccaacgattcgctgatcatttcaataggaactccgcgatatttcgcagtggtagcccacgaatggcgaatggtataagaagtgacaggagaagtcagatgcaaagcctttgccagtcctctcaaatggttattgaaattccggagggcagactggtattcccgataagcactttcatctttccgttttttattaccattcagaatactaaatagataatcagggcaatcttgcagagcaggttttctgttctgaagctgataaatcatatccttagcagtatccagtatttccacactcatcggagtcttcgttttaacacgattataatgaagaacattcctgtctaaagacgacttctccaaatgtgccaaatcagcgaaagacataccacagaattgaaacatcaaagcagcaatcgcctgtgtacgccgtaaaatatccgatttaggatctccatataaaagcttatgcaactcagttgccggcaaagctttcttttgacggacatccactcctgtatacaccccgtgaaacaaccggtgaacataaggagccctccccgattctactccacgattataaatactacgcagcatacgcatatacgtcgaaaccgtattaagcttcaagccacgttcataaagatactgcccgtaacaccgtaagtgttcgcgggttacttgtccgaatgacacggtaggtgtgccacaaaaccctctaaaagaaagaagtgcattttcatacacatgcgcagtagaatagcgcccctcttttcgtaaacgaccgatgtacatctcagcgcatcggctaaacccattttttttcatcatttatacactagttaattatataaatcatctcagatgagagaacaaatatacttcctcttagggttttaaccatcacaagaattattttatttcgaacgaaaatcagaaagcgaccctcactcacgtgaaagtcgctttctgattttcataacttaatgaacaaactaataaataattaaccttttcttaaaaatctcaaacattatatcttaaacggttgcatcttcaaatataccttatagtctttaatcatccccgttttaccggcttcagccctgggtagataagagaatcccgtaataactttatcttcaccaagatctatcacaatctgatgagggaatgcaggtttggaagaggaataattggtatgccagaatgttgattcctgcaaatcaaaaacatttgttgcaatattgttcgcggcatccgtttcctcactatcggcataaatcactttccaatgctgacgggataccggtttgccatcttcgcccaacaactccaattctgcaatagccgcgaaatctttcccatcatgggcgttcaaagcctccagacagaagaaacgagtctccaccttcttaccgaatttcacatgttgccaaccattgcctgacttaaatatcccttgataaacaggagtttcatttgttaagtccaagttctcacccatcttacgatgagcataagctccgttaccacgttgtacatccagaattggttgacgcagaccttcagtttcagcttttgaaggaccagccatatccaatataatgatttcattctctcctttcttcaaccagcagcccggtacatataaggtctgttgaggtccgatttcccaataacgaccaatcgcatggccattcacccataccatacctttactccagttcatcatattcaagaatgtatcccctaactcattgaggttaaacgtcgaccgataataagccggttgattttcagcattctcctgttgtttatactgcttatcacgggcaaaactataatctaccggaatagtatatacctgccagtccttcaccagttcaactcctttatcagattgcagttctactttctcggtaatacctttccagtcataaatacctttgccgaaattcattcttcccattgcttccaccaggatatccagtctgtcaccttctttcaatggtggtaactttactacaccttcccccttcaaacggctcagagtagccagtttcttaccattcagaaagacttgtgcccagtcatgagcttctgtgatcagtaatgtctgttctttatcagaagcggataatgaagtccgatacagaatactaccccatccctgatcaaaagcttccattgtccggatatcctcactctctttggggtgaggcagattatcaaataagactgccatttcagtcattttaatagtaggaatagctatagtcggtatcgaatccggaatttccggcaaggtttcaccttccggcaggtagttaccaagcagattccgtacttccagatatttaggagtcaccttaccggattcattgataggagcatcataatcatacgatgtgcaagtcggtgaaaagttcgggaaattcgcgcctccccaatgcccgaaactagtccccccgtgagtcatatacaagctgaaagaaatattgcggtccagcatttctttcataccttttaccaattcttcggcacttcttgtttcatgcttggctccccaatggtcaaaccatccggaccaaaattcactgcacatcaatggagtgtccggccgtagttctttcaaccgtttaaattgctcgtcgatgttagcacccgtaccgaaattaatagtccagagcaaatcatccagtgcattattctcaaaattcgagttccagtcacactggaataaaggaacacctgtaaaaccggcttgttttaccatgtcacggatttcggatatatacggcttatcgattccaaatgctccatactcattctccacctgtaccataatgatattccctcctttactaatctgaagatcagccagctgtttgcccacttcgttcaaaaagagtttcacacgttccatgtagtatgggtcttgctcgcgaagtttgatatccttcttcttcagcagccaccaaggcaagccgcccatttcccattccgcacagacataaggtccgggacgcactatgacatacattccattctcttgagccaaacggcaaaacgcagctatatctttctgtccggcaaaatcataccttccttcttccggttcatgaaaattccagaacacatacaagcaaatcgtattcatacccagtgccttgcacattttaatacgatgttcccaatattctttcgggatacgcggataatgaatctctgccgcttttacaacaaacggttctccattcagcaagaaagtattcttccccacttcaaatgtgccctccgaagattgagagcatgagctgccaagaacagccactactaaaataagtaaatacaataaaggtttcttcattttctatctattgttttcatgatatatctcatacttaataaagagaattcactatcggctaatgtttccattaaaccgacagcgaatttgaaaataatccaagtgttcctaaaaactaaaataatacctattgaaaactgagtacggtgcaaagatgaggtattatgcgtaaacaaaggtcctcaaataagtcaaaagggtatgaatatcgttcaaatgaactttatttatcattttatgaactctttttacagaaaaaatcaagatatttgcaagaaataccataaacactaaaacacctcataacgggagaccttatgaataaaacgacttttatactactaataacattaattatatcatacataaatactgcttatattcaagcacagactcaacgtgtcacagtacaggggagtattctggaaaaagacacacagttccctgttgagcaagctaccatacaactgttatccttgcccgacagtaattatgtaaaaggcatttccagcttggaacagggaaaattttcactcacaactctcccgggacgttttttgctaaaaatttctttcataggcctcgctaccgaatataagcccctgcaaataaacacaacccagactattgttcaactaggcaaaatagagttgaaacctgatgctgtacttcttaacgaaaccgtcattgtagcccaagccccgcctgttgtcgtcacaggtgatacaaccgcatataatacttccgcttaccgcgtcagtgaaggtgctgcattggaagaactagtcaaaaagctacccggagccgaaataaacgaagaagggaaattaatcattaatggtcaggaagtcaaaaaaatcatgatgaacggagaagaattcttccttaacgaccccaatacggttttaaaagaactgccagccgatatgatagatcaactaaaaacttaccaaaagaaatcagacatggcacgtattaccggagtagatgacggtaaagaagaaatggtactcgacttacgcgtaaaaccaagtatgagaaaaggatggaatggtaactttgaagcaggatatggaaatgacgaccattatagggcaaaaggaatggccaatcgtttcaaaaacaaaatgaacttatcaatcaatggtaccgccaacgacaatggaattaattccaatcaaagaataggtgccaactattctcagaatactcagaaactcaaatatggaggtagtattgaagtccgggaaaataaacgcgattcatggagcaagcgtcatacagaatcttttttgtcagacaacacttctcagttttccctgcagaacaaccaatccgatggaaagacaagtgctatttccgctaattttcgtttcgaatggaaattagacagcctcaccactattatgtatcgaccgacatttaatttttccaaaggaaactccaattcaggcaacttctcagaaacgctcaacaacgagtcaactcctatcaaccggaaagaagccacaaaccaccaaacgaatgacagattctccaccaatggctctttgcagttgaaccgcaaattaaacagcaaaggaagaaacatcgccttacgtctttattacgatctggatgacggcaattccgatcggtatagtctttcgaatacttattacttgaagtatggtgatagtataaaaactttgaaccaatggattgaaaaacttgacaaaaacaataaatatcaagttcagataacatatatggaacctgtatttaccaatcggtttatcgaaattaattatagctatcaacaccgttcctcactctctgaaaaatatgcctatgactgggataaacaagaagatacatacagtcaatatcctgacacagcgcacagtgattgctacaaaaataaatattccacccaccaaaccggcatatttttccgtactatccgcaccaactatttttataatataggtatagaagttgaggcacaaaaaacgacaaataaaagctatatgcgggacacgacctttgagtatttatccagaaatgcaataaactactcccccaccataaactttaagtataccttctctaaacaaacaaccttaaaaataaactatcgtgggagaacggcacaacccggtatgaccgacttatatagaaaaaaagatatttctgatcctttaaacatacggctagctaaccccgaacttaaaccatcattcaataacaacatatcagctacatttaatacttactttactgaaacatcccgtagtttgaatgctaacctctcctataataatacaatgaatagtacaacacgtattgtcacatatgacgaaaataccggaggacagactacccaaccgactaatgtgaacgggaactggcgaataaacggttcgcttaccttcagtactccattatccaacaaaaaattcacagtaaatacacacaccaatacaaattacggcaactctgtcggtttcactgtgctcaacaaagagtcagatgcagttaaaagtaatacgactaacctctttttatcagaacgcttaaaagggagctaccgtagcgatctgattgactttgagttatctgcagaagtcagatatcgaaaatcagaacattctatcaaaaaagagaaccgacgggaaacatttgattatacattcggaactgaagcaaacttaaacttaccttgggatataaaaatctcatccaatatcaattgtagattaaaaagaggatatggcggtaaaaatgatactaaccgcaccctatggaacgcacaaatatcgaaaagcttcctcaagaagaaaaaggcaaccgtccgatttcacctatatgatatacttcgtgagaatgaaagttcggaacgttccatttccgagaattctatcaccgacagagaatccagtacttctaacgtatattttatggcatatattgcgtatcggttcaataccttcggacaaaaaagaaaacgacaatcggtacaaaactaaaattataaaagagaaggaaatgatgtatccacaactacatcatttcctttttgttctttaaacacgctgagtaacattgaaaaaagtcatattgcaagatatcagaaattcgcaaaaggagttcggtatcaatacttgatttcctgaaaattttatacacattggtccgcgcgcaacaaagctgttctgcaaaccaagtgacagacaatccttgtcgatgtagttcatcttctataagccggccaacgtgtgtcatcttactcttgtggaataattaagaaactgaaaccacacgctcctcctccgccattttccaatcgcacaagaatacggttccacccttgacggaactggaaaggagtaatatgttcgtcaatattataccaactggtaccataatcgcgccatacatccttaccatttatccatacccggccactatcatccgtaccgatggcaaccagcatggtagtagcctcatcaaaataaagttccgtataagcataataagtagaatgtccggtagtgacaggaaccgtattatgcattgattcactttgcataaacttccatcgcagcgtaccatccaaatacacttcttcccctatgacctttatcggatgagaatccgtttccatcacccctgtacctacttgtccgtcagtatataccgcatcaaagtccacagatatctcaggcggatggacaatcgaaaagtcctctcgcccaaaactttcccacggtcctatcatataccatgtgttaatatataaccaccctttacgatccgcgctttttgagaaacgccgtccgggcaatgcctgagcttttaccatttcctgattaagccggagacctgcataagcattcatcggacgtctgtttccactgccctgagctgcctcccccatgccaccgaaaccgttcccattgccactgccttcacctccgcccggctgaccattgccaattccaaagccgccaccgggctttccgacctgcttcactactccaaagagattttccaaccgagattgagcaagtccggcttgtcgggtcgcttgtcccaacagaccacggtaattgttcaagtctgccgtactttttatttccagacctgcgctggcattacttcccgctgaagtagcccattccccccctttagtctgcattcgaatcagttcatcaaaacttggcatacgggaagaacctgtcttcagagaactataaacctcgggaaacgaaagtcccttggaaagcgcctgtttagctgcattggcagccaaatggttctgctgtatttcagcctcatattctcttaaaagagcatacatatcatctaccgacggattcgcagataacttgcccgcctgcggaatattccttgctttcgaagtatcattagcatcatccggtgccgtacgtggtaactttctttgctctactttagtcaacaattcatttttccgctgcctcatcttcttagccatttcctgaaatttacgaagctgatcttccaaatttttcttgaccaatacttccgactgcttcactaattgctcagaataattagcgggaagctcccgctgagcctgctcctgctttattttatcactgatacttttcggagatttctgttttttcgcttgcaagtcaatagctccctgtcctggtgatggcatcagccagataaacaacgctcctcctaccaggcagaccagcgcaataacccatgataggataaccgtcagacggctactccctgttgtagttttcgtcatatgttcgtattcctatattcgttaaattataaaactgacaagcatccattacttccacaaaacgtccgaatggagtgtttttatccatatcaatgcggatacgccgacccggatcagagatacaggtctcccgcaattgttccatcataaaattagtcgaacaaggttgtccgtcccaatagaagttaccttcagcatccagtcctacaatagcctgtttatcatccggtttcagttttatagctgattccgaagtcggcagatccactgaaatatccctgtttttcaccttcgtcattgtagagacaagaaagaagatcaatagcagaaacacacagtcgatcaagggcgacatagacacttccggttcatcttcgttattaaatagtgatagtctcataagcttaataaggtttactacccaaacggacacgcgtacgcgtgaatccttgtatttgacattgatcgaatatctctattaccgtatttacgggtacagtccggtaagccgccacatcaatagcaatttccgtaccttcactgttgcggagttctgtaaggaaagtattcagatcagaaatcggtacatagtggttctcaccagtgtacgcatcatgtcctactacctgatacacatttttctcctcatccactgctatgataacagcttcctctccggcgcgggtggtagacaagctggaagtcattgaaggaagtgataaaggtatttgcatttcccacttcttcatcatagtagtcacaaggaagaagatcagtagcagaaagacgcagtctatcaagggcgacatctgcacctctactttgtcttcttcatcatagtttagtctcatgcttctcctccttactccccggtgtgttcatatccgtcgaatctccttccagatagagcgtagtaattacattttcaacttctacttccaccaaagaagccaatttcataatacgatttttaataatgaaatacaaagcaatggcaggagctgcgatgatcaaaccggcagcagtcgtaatcaaagcttttgaaatagaatcggacaatatagaagcaccgccttcgtcaccatacaatgctaccagaccaaacgcttcgatcataccgacaactgttcccagcaaaccgataaggggcgacagggaagctatgactgacaaaggatatatgcgtgacaaatgtgtacggatatcacgtgcggccatatcaccagctgtctgactgacagcttctcttccggctttcacatgctcgaaaataaaacgcagcgaatttcctaatgtggaagggtatttatcacaggctgcaatcgcacctttcaaatctccttgtgcaaggcattcgctgactgttttacgcagtccttttggtgccagtcttccttctcttgaagttagcaagcgttgcaaagctattactaaggcaagcaatccaagcaaatacaacggatacatcatgaatcctcccgctttaatctgtgcagcccagtcaatctgtaccccttgcggttgttcatcctcattagttgttccctcttcatataccagcccttcctcttctccatcaacgggtaccggagttgcaatttcgctcggaagtactttcggagcattctttatatcatcctgtgtcttagcgagaaagatttcatcaaatcccgcatcacgtctctccgggcagataaaagaaataccagtcaacgtaatattaccaaaatctttccataagtccctggtcatcaccatccagtgtcccggtagttcaccgagattaagaccttccatcggatttatcaaatccttggacttaccggctatataagtaaaatcatatttcttgcctttttgatttgcagacttttcggaaacatgaaatttcattccaatttgatcacctccccattttacccaggcaaaagtgatatagcgaaactcacccggtcccggattctcgcgaataggaatggatagcccggtcaactctgccggacttttagaggctcctacatatatataattttctgattttttagagtatcccccatcacggacaaatttattatcctgagctttccactgcgccccgtccggtattttagtactaaagatttcatataatcctttaccggatctactatttgtttgggctgagagcggataagtgaaaaacgttattactcctaaaagaagtatactcaacgtaccttttctaaaaagttttttcatctttgtgcaattcatgtctattctattatttattaaaatttaaaagccaccgcaaatcatcgaatgattcacagtggcaaagttgataaaaatagaaaagaaatgagtactcaaatcattcaaaatactccaattccttaaaatgatacaaaataaagagttcaaaaatcactcaataggtttaaaaataatccattaccagaaatttccagctgttttttatctgctatatcaggttttgtatctattttcctgacactaccatcctgacatattgtggaggtaaataattatatatagagccattttcaaaagaggcagtttctaaggtgggggttctaaagtttatagtttcagcatggtatcctttaggaacaatcaattttaaatacaaaccagatatgtatccatttttcacacccttctctcttctatcatagaaatcacacataattagcttcacttttgtctgggacaagtccaatacttgcaatggacaatttaaaatattcaacgaatacaagttgacatttgaatgcaaatcaagctgagatatagcattactactacaatccaaaacctccaaatatatatttgcactaagatcaattgtttttagtctgttatcagcacaatttaattcttttaaataagggtagtcactaaaaaccggaattgcttcttctgatatttctttaatagaaagtttacgcagcgaacctccttccacattctctttttgctcagggagtatcaatttcttcaataaacgataatcattcccttcttggcgtatccactcatatccctgcaatccgcaagttaaaaattccatctttaggttagcactaaaatccaactctccaatataatttgcttcacaatttagttcccgcaattcttgattatgtgatgtttcaagtgcttttagcttattccaactacaatttatttttctaagatgcggtgatcgactaatatccaatttctccagattattatccgaacattcaagtatacttattccttctgtattcgatcggttatccggaagaatcaacttagataatatcccggcacgacctccttccgaaagtaatcctttatttctttgagatttaacaataaccgttcgaagttgtttattatgactaagatccaattctatcagtcggttataagtacaatctaaagttcttaattgaatattctttttcaagtctatcgtattcaaatcacaacttctacaacttaaattcgtgagatttttacaaccacttatatccagtttcggaaggtagatttgtataatttccaactcacgaagttctttaaatctagaaaaatcaggaatacactccaatgtatcagtccgatttcccaccaactttaaccgacgtagagaagaaaaatactcaaggccttttaatgaggtaatttcatgtctcgtagttttcgctctattcacgtcattattaatccataaactggttttcagctccaaatcctccacgtaatcaatatccgataataaaatagagctggtatcagctataatcttcatttggaacaacgctgctttaagcatcggatcaaatttatctgccacattcttattatcagaagagttcaatatgtctgcccgactactcacacccatcaataataaacttactattaaaataatgtttttcattttctattaaattttatgttgtccataatcaaacatctctctacttcacctttttacatgagatgaattatcattcgcaagataagaagaaaaaacgaaaaagaaaaggaaagagtgtccccaaaaaggatacaatttttcatcccaaataagcaaatctcctttcctcccttcacccttcacaactccctctggcacgacgattgcgggtgaaggtctcctgttcaccatccgcttcacctcccatcagacggagactacccgatacacattcccaaacttggtatgcttacgttctatccccactgctatcagtatttgtgccaaactcgccggatttgccccacgcatagctgccggatttatcttcttcaatcgctgaaagatatcagcagacgaaagaagttcacacccttctcctttttctgccgcccgataacaggaacgcaatacgtcttccacaggtccctgacgatagaacgtcatgttactttgctgcaattccgtctcttcctcttttgtaaaccaataatgttcacccgccaaaatctccgctttcaattgagcataaagttgtgcatagtcaatcccctcacaatcgataggatactctaccagcacacaaataaacctgcgactaccagtcgggtcagtcaataaatcttttcgattcgatgtcccgataaaagatgctatacgaggtagcgagcgataatttttctgataagctttgcacaggcttaatgaagccatctgcatcagattcttcaataacggcattttcgtcggagcatatttatcaaactcatccagattgagaagtcccatctccgccaatctccgttctatatgcccttgactggttaaatccaccttatccatataataacgctgaagcgcaggaggaagtagcgatttgcaaaaagtagactttaaatatccttgctccgtactgataagcaaaggcgccacactattggcatgacttcccgtaacccccatccattgtgctgtcataccccgcatccatatatggaattctttcacccacaattggtctctcgaaactctgcgtgccaaagccgccaaacggtccactccatcccataccggcaattcttccaaataaagtttgaaaggatgatactctgcaatacgggtggagaaaatacagcgtgaaagatcacgatcccaacaagaaatacctgattcgtgagcttccaggcagaatgtatttaagacacgctgattcacaggtgcaaatccttcctccattcgttccaacaaacgatattccgtttcttctgtcagcacattgtagcggaaatcatagcgggattttaaaaaagtatctacgctctcagttagtgacttcactttcgatgagtctttttctttagacgatgatacccccttaatcgactgaataatagtattgacaggtgctacactttttgtatcccctactcccgtttcatcttgttttgaaagacacttcatcaatttttgccaaaaggcaaaccaaccatttttttgttccattttcttcttttttttatgattaatggatgcgaatataatatcaaaaaaaagccatttgcaacttttcatcctattcattttttgaaaaccagacttatcattaatatcctatcatttcttgtttatcatactattaaaccttatctttgtcaccgacaaattatatttatcaccaatgtgataagatattatcactactatgataaaataacatcattattgtgataagatcttatcatagtaatgataagtataaaatatcagcactaaaaacaagaaatcatttaaagataaagcagaaatggcagtacaatttgaattatataagactccgatgccaaaggagaaaaagaacaagacgcgttatcatgcccgtccggtaagttttgagaccgtcaataccgagaaactggcttatcgcatccatgatcgctccacattaagagtatcggacattatttcaaccttggaagaactgaaaaatgaagtagctcagtgcctcctggaaggtaaaaaggtgcatgtcgatggattaggattctttcaggtcactctttcctgcgaagaagaaatacgtaacccgaaagacaaacgtgtgcaccgggtaaaattgaaagctataaagtttaaagctgataaagaattgaaaggggaattgtgtcacatgaaattccagcgttctaaaatcagaccgcactccgccaatttatcagaagtagaaatagacatgaaactaactgaatattttgctgaaaatcagattatcacccggaaagattttcaatatctctgcggaatgacacaaatcactgcatatcgccatatcaagaggttaatggcagaaaagaaattgcaaaataaagggacgatctatcaaccgatatatactccggttccgggtaattacagggtatcggtggatttaaaatataaagaacaatgaaagagccatgaaacaggaagcccttcacccgctcttccccatttggggagtgtaatttaaactctgtctggtttctatttcttttaaatcacaacaaatataattttttctttttggatttacaaatgcttcttaaggtagtttttggatgtgtgcaagggcggcgaagaatgagccgtttatatacccttgctcacatccgggaactaccttttctttgcgtttgaaaagcaaaaaaggggaaatgggttatatcgccagaggcattctctctccaaacttgattcgtagttgcccggcagttaacgcccaattctggagcggttgcgtccatttcttggagatgttcatcacagccaggtagatcaacttcatcaatgccatgtcattgggaaagacacccttggttttggtcacctttcgtacttgacggtggaagccctcgacggcgttagttgtgtaaatcagtcttcggatatgctcatcataagcaaaataggccgatagattatcccagtttcgtcgccatgattccaagacaacagggtattttttaccccatttatcttgtagtttatcaaggttgagctctgctaaatctttattaggggcttgatagactgttttcaaatctgccataaactctttttgatcttttgaggctatgtatttcaatgaattgcgaatctgatgtatgacgcagttctggatgattacctcaggaaaaatagtgctgattgcttcagcaaatcccgtgagattgtcaatgcaagcgatcagaacatctttcatgccacgtgctttcaggtcggtcaagacactcagccagaaattagccccttcgctttctgatacatacatgcctatcagttctttatggccatctttattgactgccagaacattatagacagctcgactttcggtacgaccaccatccttcaccttgtagtgcattgcgtcaagccacacaatggtatacattgattccagggggcggctttgccactccttcaccttgggaactatgcgttcaataatctcacttagggtgttgtgggagatctcaacatcatacatctcctcgatatgggaggaaatatccctaaggctcaaacccataccatacagactgataatcttggaagacatgttgtccgcaagaatcgtctcgcgctttttaaggatctcaggactaaagctgctgtgacgatcttgaggagtcacgatatcaatctcgccggccatggttttgacacgtttgctgccacgaccattccgcttattgcctttaagacgctctgaatcatcaaggtgggaggacatctcgccatctaaagcggcctctaaaaactcttttagcaacggaccaaaggctccgtctttgcccgtgagcgattcgccactacgcagttgagataacgctttgtcacgcatctgctgatactcttcactgtttctatccataatacaaagataattgtttggggacagagttcagattacgccctccccatttgataagggatgtagagagaaggtgaagggctgataaattatacagaactattccgtattaactatggtttcaaataattttccaaaggttccatagacaattcatcttgatttgctccccaacaataataaggctttttatccttaaagaaacatatatgaggataagtattttctcgagttaaaataaaaaatgtcccatcatcagaatgctctctagcatattcaaacttctttgtttcatttttctgcggtgtaaacgacataatttcccatctttccgcttctgtcctctttatactactttctaccatcttgtccgcagcttccttcccaaacacttcaacatatccttgataataacttttcggattcgtgtctttcataaagttttcagcatgatatatagcataaaaatatattgtttccccattatcattctgcccataaaaacaagcaaacttttctggaattctaaataccttttctgaatcgttcactaaatataatcttgaaggcgaatcaataaccggtacaaactttatagtggacttcatcaaagttaaggacaaggatgaatcattccatctccctgcaatattcatgtttaatcgttcaagtatggtatcctgaacatttttattaatctcctctacaagcagtttgttttggggtgtaagttgactgatagcttgagtaatcatcttatctctttttataacttgcttggaagtgccatcgacatacacttgttcgctacatgaaagtaatagtatctggacaagaaataggattgataatttaattgttttcataatatttcttacagatatcttttatgattgatttaaaatattaattacaactttattaattgagtgagaagagtaccgacataaatatttaatcgatactcctccattaattccagcatcaaacaaagttttcttttttcgtcaaattattccgtatccacctcttcgcgccattcttctgaaagcgcatagttattgataaacacgtatccatctaatgtggatggcaccgagatgcctaaccaatagagaatttgcggtactatcagcgtattctcaacacagattctttcagcattgacattggtaggcaatgtatttgcaaacatggcagaagctttctgttcgatatccggagaactgcttgttttatctttaatataatacatattgagtccaccttgtatctgatttttaattactaatgtatcctcctctaatttctcaagttgctctgttggcttgaatttccaatagccgagcatatcaccagaaggttcaatatcaatttctcccgatagttgcaaaaattctctttcagcaagatcctttttccatagacgtacttccgatatataataggaagttggtacagaataaccacctatcgccaaaagacttgaatccggagccaatccttgggtatccgtagttccagatccctgcaacttaccatctaaagtaatgagccaatttctccttccggaggcagcggaacttatgctaacaccatagtgatgccatttagaatcattgtatccggtaatagcttgctcaagagcaggaccttccttaggatttgttctcatggatacagttcctctctgcctatatagtccccagccggcttttccaagtatgcgatcccaattgttaccattatatgtaccgtcctgcctaggaaccatacgcattatgatctccattgaaaatgcatccatacctaaagaataatatttacctatactatcaaaaacgacagccttgtattcattctgagaatcaaaatatgcaccgtatagtctattaccattcaattgtttttccgtataatgattgtagtaaaacagaccaaacgtgttacgctccacttccgaagtgccaccataacgaccgtcagccgatccaccgtgattggaagttacaacaataagccagtcttcgtaaaatgcattctcacgggcatcaatcgccgacaaaaattcaccaatgtatccgtctatagttttaagtgcactgacataagcggcgttgtccgctttgaatcccccactcttcccagcctccaacattcctgaaaaatcggccagaatgaatgtgtaatcttcattcgcaatatgattgagaaccacatcccgagtttgaacgtcattttctgaagtaatggtagtcttagcattgttaagcatatttttgttcagtttcgcccaaggtgtcacacacaatgaaagcatattcacgtcattattcgaaatatagctaataatgttttgatagtgaattaccttttcattcggattgttcggattgtactccacattagcagtataagattcatcggttatactgtgcttttcgggtatgaccccagtgagcatggttgcccacgttacagggtcttcgttcctctcgacagacagggttcgattgtcactaactcctgtccacgaatatttactatttttcaacatcttagcaatggcaccatcggcaggaagggagttcttcaccacttcaccaaccgcaccatctatatttatccataatactttacgatggattttggtagatatgccggtatctatagttccatcgtctgctatttcagcaggtgtatcgtattccgtgcaagcatagttaaatgccaggacacaaacaacaagcaagctgtatgtgagaatatttaatagtttattcatctgatataaatttacggtttataataaaatgtaccaaactcggtaaacgactgtactctgaacctaaaacgagacatatctgtttcattccagttatcattacgattaggttcaggaagttttatacgcagatatctcacttgttcttttgacggaaaatcatagaaaccctcacttttaatattgggcaactcgggatgtgcaatggaatcaatctgcacaatttccctccaaactatattttcgtcaagcggatcattaataatatcctgattgacaggagtctcgataatcagcttagttgccgcaaagtctgagttgttgccagccagaaatacaccattaacatctgtcgtctctttcatatcaataaacaaataatacggaagtggcggagtacttgtatcgttgttgtaatatgaagtccatcctgttgatttgtcgctgtccaacaatcggtccggcgactgccctgaattaaagttatcgcttccatttgcatccagtgcataaatctcccagtcagctcgattatgacggtagtgatacccgttacttgggaaatcaaccacaccacttgatggattttctgccagaggcgagtatttccatatggctttatccatcagcggatatttcgatgcataactacgggcttcgtctgtcagcgaatagccccaatgctcaaagaatggtgaaaaatcttccttaaaatagtcacataaagccttaaagaaataggtagaagtagaatgatctatggaaattttatctttaatcatacggttcaactctatataaaaagcccaatcgtcatctttgtagttagctaattgaacgaggcttgccaatgcgtatgtcggccgtacttccgactttatatcagatacaaaccagcggctactatcggtatctgcatatgccaatgctttggggaattgctccgcaatgctactgccttcttccgggaaaatcggtcccatcggatacccatcctctcttaatcctttctcagccatgcgatataggggaattgcttttaccgcatcagatacttcgctccaccagggtgattttatatctctgaaagagtaatttctatataacgcattaaaaatagcaacagaattaccggatttcaacgtttgatagctagccagctcattcaacagataatttgtattcaatgccactacaccataatcggcattacgaatatacagattgtccaacaactccacatccagcaccacacgctcaggaaaatcgggagcacgcattgaaaaatcctgtgccccaacctgcaaactgtaatagttataataataggtctcgacagcattgtcccatgcttccagtgtgttcggcatcttttcagcaatgataggatcatcatttatcatatccaataatcgctcacgctgaacggaaaaagcgacatgccggccacgcaactcgagccacggtacagtcgttgtacgcaactgctcaacccacgctgttacatcagtagaaccgacaataaaatcaggcgaacgataagccccgttaatctccataacaaaatccgcactaccattcacatccttgcttttttcgatccatatcatgcctcccaaaggattacgaatggtgttttttcccgggaacagttgcttcgaagtagtaactaccggcaaacgcaagtagggagaaatatccgtcaaatcatctaaatgagaaccgatgataaccgtcaaccccatagtgttgtcattaatggttatagtaatcaattcacctgctccggcataaagcccggtgctgtatatcggacgaggaacttgttgcacgtcaagatcgtatgcaggaatgtatctcttgcttaaatcaagcgcaagcagtgtattgacagtattatcgactaaagtatctaccaaacccggaaaaacacgggcactttcatacatactgacatcgattccttcacctgttactatggttacattggtagaatcggcggtatcatcctctgtcccgctttcgatatcatattgataagcaatgttgcagcttcccataaaaaacatacaggaaatgaatgacagcaaaactgcatagtcggcttttagtttattaaagcatttcatattgcattctaatttaattatttaaagaaacgtaatctaatgcccagccttcaccatcgaaattccaggaagaatcaaccggctctccaaaccattgaaaaatctgataggataaatcgactgtattaagaaccgttttatagtaggaatcgtctataagtgggcataccttatccgttacaatactctcctgcctgcgcgttacgtaatcatcggtaggcgcaaacgtaccaaccggcttattgaagtataatcttttatcttttgatgtatatttcgaataatcttccaaataagataatccgatatcatcttcgcgatcgttggggtaataacccaccagattattccaatacggatataattcacccaaaaggtccagttttgtagtacaatgatactccgcaataatatcagcaggtagagcaacgttgtaaaactggagatcgtttatatatagatttgcctgattaggtctgtccggagaaaacgtatgtccgatggcaagaggcgcatctgtccacatatctttactgccgtctatcttacatcccatctgatacttaccgtcaagataaaataagatggagtcacctttctgggtatcatcaacctcttttataactagcgtataagaatgccatgatccgtcacgtctcgtagatggtaagcggaataccgaagaaccctctttaaaatttgcagcaaattcgacttgagtattattagaaaacattagctgccagcctgtacctgctttttgatatcttttcgatattatatttctattaccccaggggtcgccgtgcttatcaaacattttaaactgaatggtatatccacttttatccacctcttcatccggattggaactccatcgtttacccatattaaaaaactcggtatttccagtcataacggcatttgttgtcgctttttgtccgggaccgacgaaataaggactatagaatttgtattgtagttcatccgagcccggcctttgcaacaatttggatgcaaaccgactgttatagagcatcatgaaagaattgagacgcggatcatcatacaacgatgccggagttacattaccttcataaacaccaccataagaagatgtaataactacaagccagttttcctgaacgtaacgcgaacgcgcttcaagtgctttcattattttaccgatgaaagcatctacattgtaaatcgcatcaataacctcactggtaggagttgtctcattgctccagaatccatattgctcaccagtctgttgaacaccgccgaactgtgcaactacgatatccgagattgtttcaccattgatttcagcaataagagcatcagcggtttcactgtcggccgaagtctttcttttagtattggcaacactcccgaaagctccgaaaaactccgtatcggaagaataaaagctgacttttagattttcatccgcctctttcaatcgttgaagaaaagaaggcgtttcgagttcgtcaattccttgattgacatcaagcccgttctttgttgttccggtcagcaaatttgcccatccacgttctttacttaccccttcttcattgtcggcaagtccgtaaaaagtaaacaaagatttatccgtcatggagcggataactggagcctttcgtgtattatacgcctcattaacggctattccggatgcaccatcgataaccaccatcaatacgtgtcccgtagtatattcagtacccgactccggataatcatcagtcaaaagcctttccatctcctcattgcacgagaatgcaaatacagcaaacaggcaaagcattatattttttatcaacttttccattgtatttcataataagttattcataatcaacttctatcattatcgcattgcgaaccatattaccatcaaaacgactaaaatcaccaagcagcagcaatccgtttgaattggtcgaagtacgagtttcaattactttgtagagttcaccctggaagatgcccggtacattaaattgttgcagcgcctttccatcacgacccaatataaggaaaccacggcgagttacaccatcgtatttcgtaaacgcacctgaaacaacaatattatcattatcaagcagacaggcaaaattggccaatcctccttccatttttccgatcttgaaaatttcatcacgtgtgccatcatcattcaacataactacactctgtgcaggaataccgttgaactcagaaaactccccagttataaggattttctttttgtttttattgtaccggattttagtaatacttccatttgcgcccgtaccgatgtttttcataaaagtttcatcaagggtaccttcggcattcaacttcacaatattcttcacagactgtccatcgaaactgctgaatgtccctactatgacaataccgtcactttcgaccatacaagcatctaaaatctgcccgataactccttctgcatccctgcgatagctatcatcaagttctccagtccttgacatacgcaatacacttgcaaccttcgaataatccaaaaccatactctcagcataggatttttcggtattaatacgacagtagtttgtaatatttcctactgctaccaccttctcattggaagttataaatgtacggacaggcgcttcaagagttcccccgttgaataccggtatcttacaatttatgcttgtattattctttttcgaaggcagcgctacagttttataatacgaggctacttcattagtagctatcgtgatgttattgaccggcaacttatcccagccgtattctgaaaatttacccgagagaagaaccctgtggtcactaggaaaataagtaaatgaattaaggtaacattcaatatctgtcactcccggattggccagatcaatgccggctccctgaccaggatcaagtttgaagtcagttacccattttcccgatacagagccgtctgtcaaaaccatagatatacaagaaaaactctgcgagctattttcattgtagtaggcctgcatatagtcgccaactggataatatacccgtgcttttgaataatgttccgcacaatcgtaaataggtcccgaagtgcctttaaagccgtatgactgatctatcttaatatttcctaatacagtgagacgaggtccatagaaaacctgttctttcaatacaatataagccgtacccgaactaagatttccaggtactttcacggtgattgtcgtgtcggtagcagttacaattttagtttcttcatcagaaatataaaacttgaaatcgtaacgtcctgattgcggatcacaccagttcaacatcccttttgctttgaatacaaccgtatcattgggataagcgctttccggagaaggagattcagccagcaaaccgattccaagcggagcttttccaccactgtacggatcatctttaatattgctgttcagatcactgttacaggatgttaccaataacgaagtgaatacggagcaaacaatcattaacgaatagatggtaatatgtttcattgtactatctttatttatagttaattatccggttctgtttctattgtcgcatttatagctttggtagcgaaaagatatggttcaaaaccaaatgcatgatcggttaatctgagtacatgtaccactccgttggtcggttgtatatcagatgttgctacataagcgtttttcatatctcctatagtgaaatcatagacataagagtatatgatttgtcttgcaccggcatatttcacattgtttgcatcataataaacaacacccatgttcataggctgctgaccataagataaaaatgcctgtcccggataggctgctatggcagtcgtatcaatttgaggtatatctttcagcaaatatttatcttttacaatgtacattgacagcatttcacgccagacttccggttttatctgactaaaactcttgatgctatcatgccccatacgataccaaatacggttcagataattaaaactaccacggattgaccaatcggtaggtgcaaaaaaggtaatttgttcgtcttcaaaaacatcttccataccggacagccggatgacttccaccaaatctttaaaataatcgggtcttgattccaaatattgcatcatattcccattataataagggttcgcttttccaccatcaattaaataactatcatcggcacaattgtacatgagtactgccaaaaggcaacatccgacaattttcttccataatttgatattatttttcatatctatacattttaagtttatcagagttactcccaaaataaattcaatccaatctgtgtgttgtttttcaacgcattacgatgaataggccatgtccatgcccccacattgaaattagtacgcgtcatcggattcatacaatagtttctgttatacacctttcctgtacgaaccaaatcataatagtaatgtccttcaccgataagctctctgcagcgttcccagaaaatagcatccatcagttcactacccgaggtatttatttcggaagcatgtgccctattgcggacccggttgagtaattcgcaggctttcgtatcgttagtccccaaagcggcaagagcttcagcatacaacaaaagtgcacctgcataacggaatactatttgattgccggaattagatgtaattgttccgtttccataagtatcaatattccaaaacttcttgatttctttaggagcagaacttgaaaccgatgtagaatagattttttcgtcaaaccataattcttttctcgcatcatcttcatacatagggaacagcgtcataagataatctcctgaataacagaatagcggcattgacttattcaaacaggaataggaaacattatcagaaaactttgcattcatcataaatatctcattgaaatttatattctgtgcaatctcaaacaagccttcgtccgatcctcctgcgaaaatcacggaacttctatttatatcaagtaatgaataagctccattgttacgttccagttcctcgcctagcgaaacaacattcctataatattgctctttattttgtgcatcaaactgtacaagccacaagtttatatgcatcatcagcgcaatgacagaacctctggaggctctaatccctttgctcgaataagatgaatatgaccatggtaatacttccgctcccggatcatcgtcaagcaaaggttgtaagtcagcaaggcaattttgcaaaactataaccatattggttcttggcaagggagcttcattataggcatttgtataataaggcacatctccaaaagcccttacaatgaagaaataagacaagctacgcatgaaaatagcttctgccttaaaacgactccgtttcaattcatccatgccgggcactttgtctatttcagcaagcagaatattggcatcctgaatagcagtataaaacacatcccattgcattattaaaccgcccctagcatcatcgggatatgtattacgcaattcacccatatcgttgttagccagataagctacatatttatccccagtgctgtaggctgttattggagcgcaccgcatatctccgctatacgtaaggaaaggacgttgtgacattgttgcattccgaaacgaattgtatatgctcaacaaaaaagcttccgcattcgtctcatttccctgcgcccaaaaatcatcacccgataatttatcttcactcttatttgcaagcgagtcacaaccggcaaacaggcaagatactatcaaagtcattattaaaactatatttttcatattcttctatatttaatcgttcatctaaaaatccattgagacaccaaatgtcacagtacgaccattgggataaccaccggatgtgtcatatcccaaattgtttacattctcgggattgatgcctgaatatttggagaaagtataaatattgttcatactaaaattaagctgacatcggctgatcctaaaaaaatccagcattttctttggaatagtataagccacagatataccgttaattttaaaataagagccatcttccataaacaatgtctggtcgtatctgaaaggctgaataatacttgaacgggtataatcaaacggattaggatattgggcatagatattatcttctgtccagaaattatatgcctcaataggtgttaaagctccactacctgtaaggttcaccttacctgctacaggtgttccataagccctaaaacggtctgccagagccttgttgataatatcacgtctcaacgtaaacgagcagttagtgttgatagaaaacgctttataacgaagattgatactaataccaccggtcattcgcggctgtgaattacctacaatcaccttgtctttttcatcgatgatataatcaccatttacatccacccaaatagggtctcccgccttaaagtatgcttgagtagaagtattccctcccatccgcaagcgttctccggtcagcggattaacaggcacgtcttcgtcagtcgcatatacgcctttatacacatagagataattccccatcgcgttagaacctaatttattcaccacttccgcatcactgttaataatctgccgcacctcgttaggcagctttgcgatcacgtctttattaattgccagtgaagtcgctacattcaaatcccaattactttgccttgacaacggacggacgttcaacgaaaactccaatccatagttaaccagactcgttttcgtacttcttacggaattaaaagcattgtggttagccaactctatcgaacttagctgattgtcaatttgtttgtaatacgcctcggcaacgaacataattttattattaaggaatgataagtctgttccgagattccatgatgttgacgttaccggcttcaaatccggattcggcatagcgtttttatcaataggaataatagaaactccattataagtatctttgctcagattgtaacttccccatatatcataaatactagctttataagtggtactacgtccccaagttacacgaagagctccggcatccagaaacttccattttttagcaaaagattcacggctgaagttccagcgaaatcctaatgaaggatttattgcccatttcgcctgcgacccataagatgaatttatttcaggacgaatattgggagtaaatacgtatttcccaccaggcagcgataactgaggatctataataagtgcaaacgtattctttttatctgaaaaattcgaccttccagctgccatggacggcataccggacgaccatatatggtcacttgccaatccattcagcataataaagttaccgctatacttttcggatgaaagttcaaaacctccctgtaaatcaaaatttacaattcccaattttacggttcttgacaacaatgaacgaacatacatattataactatattcactaccgttattccaagtagccctattggcattcaaaatacccggcgtaaatttctcattctccacagttccgtatttatatcctaaagtacttctccatcttatatcaaatggcaacagatacatgatattcatacttgcatcatagactacattctgattatctgcctggacagaaaaaacagacaatgcagaattggaagctgtatacatagacggtggaggcaacaaggaagaagctgccgaacctgcggctacgccggattgtgagaaagcatttccgctaccattactatttcgggttaatgtagtggcaagatttagatccaaatgaaatctatcattaggcttatatcctactgctgccctgataccgtatcggttaaagtccgtgtttttcacaattcctttttccgtataatagtttgcattgatcttatagtcaaatttctcattaggtttaccagagaaactaagattatgagtttgattgtaagtcgtctgataaaagacaccctgccaatccgtattattattgtaataaggattcaagctatctgacagtgcctgcaatttatggatttcattatatccgtgataggcggatgtatcatttcccaaaatttgcataattctgagcgctctctccgccccgcctgcaagtacatctctcaacctcggtggtgttttcactacaaagttagccgaataagaaactttcggtttggctgtttctcctcttttagtttctataagaattactccgtaagcaccttttgaaccatacagggaagttgcagctgcatctttcaatacttggatattcgcaatatcttcaagtggaatcatagccaacggactgactgttgcacctgacagcaaaccagctgcatcatagcccgttacgtcttcctgcggtataccgtcaactacaaacaaaggaggagtcagccccatcataaactcgccatcaccggaagattgaacggaaatatccgagactcctcgaattgaaaaacttggaagacctccgggagtaccattattcatctgaatatttaatccgggaacacgcccttgaagcaactccatcggattagcaacaggagtattgaccagatcttctgctttaataaccgtaaccgatgctgttaccgcagccttactaactcttttaaatccgactacaactgtttcatcaagcatattctctgtcggactcagatatatttgcatgcgttctgaaggtttagtaactttgactgaaagactgtcgaacgccaggaaagagaatacaagtcggtaaccactcttaacttttgtagagaatcgtccgttatcatcagttgtggttgaaagctgaggcaccgtttttccactttcatttttaacaataacagaagcataaggcaatgtagaattattgcttttatctttgactacaccactgacaggaatatcctgagcccgaacaccaaccgaggtgacggcaatcgccatagccaacaagccatatttaaatatatttctcatattagaatcatggtattaattagttattttccatcttcaaacaagggggctcctgctgtaaatacaactattatctcccaatgagcttccttgtatatcgcaaattcaaatgacatagtggatgtcatacgataaccacttgctgtaatacggtcatataaaaaattgacatttattctattaccatctttattggtatattttgatttcatttcaaccaatggcatcggataaactacatcatactttacatattcatctgttttctccatattgaaaccatgaatcagattagcccagtctgtctgattaaaagatgaaggagagatcggtgtataatccggtccataaaaacgaaaagtcaaactttttacatcatcatcattatcttggttctcacgaaaataaatatgtacatcttcaggaaacatatagtctccactttctgtttgaaaaagggttaacgaatttggtgtaacatagtcctgtccctgcaccaaccctgtttccggatcgtatatactcggttcgtaatcactttctctgacaggtataagctgcatatcagtaaatgttttatatcctcccgagtttttcaccagcacatcaaaaatatagccatcactcggagcacactgcacaaaagaagattcggcattggaccacatcataaattctccggaatgctttttaacctgaaaaagagtacgatattctatttctcttttagcttctatttcttctatagacttttcggtacccatatatggagttttccaaacttttaccgggaaatattccgtcaattcaggtgcaggacttccgtcggccctcacgattcgtgatatttcgaaagtaagaggaagcgttgaattacccgatgaaaagttgtcggacatcaaagtattttttcctagttgaggacgatatagttttgtagtaaaattgacgtctctgtcgaaagcatccaaactatccggcaaatatttatcgacacacgatatgcttaataatacgcaggaaaacagcagcgcaatatttttacttcttatattcattgccataattattaaatacgtaaataaattcatcaaaaccgaaactgtgttggggagaaaggatgtgaatgataccattatttgtataaacatcattccataccgtagaaactctgttccagttatcttttacctgagagtttttcatatcactgaaaataagctgtttgactcctccgcctacaaatccggatgccggtttgcgagaacattctatattcatttgataattgtacttcaaagaatttaaggagttatttccttcattggctagaatattatcggtatcgtaactacctttaataatgtacttgcataacattcgctcaaggtcagctctataatcataatgatattcgttaatgatcgtatcatttaaagtcggtgttataacattaacgatcgtatctttaacaacaaacggttcaattaataaatcactcaaataaatcgcttcacccaactccttttgtttacggtactcgttaagttgcgccaatgaggaacggatacatgcatccggtatggcaaaaactgtatattgcacatccgtctgttccatctgttgtatgaaatcgggaatattgttgacaagaaccatcatagaatcaaatttcaaattcagcctttcattccctgtggacaaataatccagaacggttccattaaatacttcggtttcattttcctcaggatatgaagccacttcgtaatctgtacaagacagcatccaaagggaagccgaagtcagacataaaataaatagtatcttattcattgtcgttttctttttatttccaaaactcattttgttcaatctgtgaattagcagtaatgatatcttccgataccggccagtagattccaccactgctgatcagtcgcaagaatgcctcattatctttcatcagcttttgccgacggacaaggtcataccacctccagccttctcccataagttctctgcgacgctcttcaaatatctcggcaattaagctttcgcgattattcccaaaatcctttttaaaagatacttctctcaatccacgatttgttcggatcatattcaggtaggatacagcttctgtgctcctgtttagtgcgcataatgcttcagcccgtagcaaggtgatatcttcaaggcgagtgaaaacaattgacgagccaaatactccgaaatcattgtctttcgccgatccatcctgaataatctttattttactgaacaccggagtttcttcattcaaattctgaacataataggatgaatatttgatggtatctatgattccaaaccgcaagtcatcaaaattggtaaaaatcgaaaataagctgtcctttgaaatgtatatttcaggataggatttttgtaccaatggataagctaaagtcaactgttcaagatgtccgctttgagttgcttcgttatcattgtgagcaaaattaaatcctaaaatccttgaaccttttacactcgcattcgagtaaaacagccctgtttctgaagtcaagtcggcaatagaagtatattttgcattaatctcagatgcatgatctattataaatgcagaatatgtctcggcttctgcataatttccctgccaagcacagatgtgagctaatacagagtatgcagataacttattgaacagttttccctgccattgggccccatatgaaccataatataaattcgtttgagtaccatattgatagggtaaatcctctatagctgttaacagttctgccttagcataactcagcaccgtttgagcgtctgtacggggcatagacggaaaagttccgttatcataagaataggtgactaacggcacatctccccagattcttaccatataaaaataagcaaatgccctcaaagcgcgtacttgagcaatgtcatatttcaagttttgttcagaatacgaccggtcaagttcgacagttcgtggagctttttccataaaaacagatgccgcattgattaccgcataaaatcttctccagttagatactttcttcaacaagtcatatggcttgttcaattcattatcagacacagcttgtaagtcactacgcttataaaccgtaaaatcccccttccgcaaatcaccacatatccaatgagtattgttatcggctaaggctgcgcgtgtcaagccatatactcccatcaatgctgatcgagtatcttcaagagtcttccattgttgggtttccgaagctgcatgtttgggatctacatccagaaagtcattgcaggactgcagaaataaacagacaagtgcggagaaaagagctaatcgcaattttttcatattgtttttcatattgtttttcattttttatcatctccgatatttttagaacttaaatctcagtcccaaagaaatggaacgaggaatgggaagcgaatacccgtcataggtaccattgaagttaactaattccggatcacctgctgaaaaattactgaaagataacagattagatcctgtcagatagaaatacaaacttttaggtatattactaccaactttctttataggaagtgtgtaaccaacagttatatttctcagtttcaggtatgacagcttttcaaggaacaaatcctgttctgcacggtaaggatgaacactgctttgcggattgtatataggataatcgtcacgctgattagtgttttgccaaaagaaaatctctttaacagactgcaaggactgaatattatccaaagtcgcaaagtcgtaacgttgctgatcgcgcagatttaaagcactatgccccaaagcaaagaagagattgaagctgaaatcgaatcctttataagcaaactggttagtcaatcctcctgtatagggtggaatggcatgtccggtcagcacacggtcattgtcgttaatctgattatttccgtcaacgtctgtccaaacaggatctcctgctttaaaaggaactccatttatgttcagtggtttcccattcataacaggaacttctgagtcgtttgtataaatgcctttattttgatacacccaaaaggcatcaactgactgtcctacttgtagtttatggtcgcctatcacagttgtcttctggttttcgggaagtttctctagtttgttcttattataacttgcattgaaagacaaatcccacttcaacggagtgttcttcaaaatggatgccgaaagatttaattccaatccctgattactgatatccattccactggccagtttatactcatatcccatttcttgagtgacaggcaaatatgtcaataaattcttttcataattcttatacagacttatttccgcaataatgcgattgtcgaaaaaagaacctttcaaagcaagctccattttatcagaatagggaagctttaaatcataaccaacccaacccgatgcatacggacgagtgattgttgcaaatccattagctgaggaaagtaacggttcgccactccatgtgatacttgtagccaagtattgaggacctaattcatatctatcggactggaatgatttggctattcgtgcataagatgcacgcaaagacaatccagacaatgcagtactacctgtaaaaaaatgattctttaaattccattcagcagaggcagcgggtgtaaacatccatctgtgatccgactggatagcggaatttccgtcgtatcttgccaataatcccacattaagcaaattcttatacttataatctaaagctattgaagtcgatacccatctattctccaaacgatcaacataacgatactgcttgaagttcccggtacttgttgtcggcttcatatcatcatcaccatcataggcacgagtataattatagtgatacaaatcgctggttatagagccattccactgaacattcaacttatgaatatcagctaaaggcaacaaatagctcgctgaagtttcacctataatccgttgattgtatcctgaatagttagagacaaagttgacggactccaacaaagccataggccaaaaagcgcgacgaacatttgttgtataatcaagtttgatgctggctgtagcattgaatctttgcttagtatagctcaaagccaacaatccattcagtaaattgttataattatcatctttagtcaaatcattggatattaaaaagtcattatacaaattgccggcaggtgcaagcggagttgaaaaatcaaccatgtactccatctcagcaaacctgtctctaaaattccgattcctgacacggtctatcttagcggcattaataattgtactaacattcaagccatccaaaggaaccatattcaaggcaaaaccaatattatatttcgtataagaggtattgtccgctgctcccgcatcttttgtcgttgcgagtgtaaatacataattcgctttctttgaaccaccaccgatagaagcatttacattatataagagtgatgactgataataatcgtctgcccagtccggtttaccaaaataacgtacatctcttgtatccataagataatagggttgtttacccggtgtaagagaatacgtatcatagaaacgttgacggaatgctttttcgtatgatccattcgtcatacgaactgaagacggagcaaaggccattcctgccgaaaccccgatagaaacgttttcaccgccataataaccgtctttggttgttatccagatggcaccattagcagctaaaggacctaatttggcaagctgaagcggatctttgataatttcgattgactctatggaagatatatccaatcccgccagcatgttggcagcagctcctatcggattaatatcaaactgtttgatatcgtacacatagctattttccagcatcaatggaacgccattcaaataaactgtcggctgaacactggacacatctttattagaaaagacaggtgaagataagccacgaaccagcatgctttgaatggtaccaggctctccattattttcctgtacatatacaccgggcacattccctttcagtaattgctgaatagataaaaattgagagcgctgcaacattttgatatcaacagtatcactcaccccaaaggagtctatactacgattagtaacgaaacgagatcctacattcttctcaaaagagtttttttcatataggtcttcacagaatcaatattcgcgggcgaacttgattgagacgctatcgctccactaaatcctaaaaagcccacgactgccagcaaacgacaaacaggcttttgcaaaaagaaattaggtaaaattatcaccatactattagatttataaagttatttagaccaaataagtattagttgtgcatcaaatgcgtcacaaaagtgcgagttatccagtagaaagaagttctctaatcattcaaaaacttccaaaattggaccataatcgctattaactataacaggtctaaaaatcgttcaatataagttcaggaatcattcaaatgggatagatcattgatatatggaaaagtacgcatcttccattaagacgcgtacttgtgtattttaagttcatattatttttatcctaacaagatttttgatattcctttggagttacgccaaattcttctttaaaacaggttgcaaaatatttaggattagaaaatccgcattcataagctacctctgctacggatattgatttatccttcaataattgacttccatgttttaatcttatatttcgaataaactcaatgggtgacagtcctgttgctaatttcattttcctataaagagaagacttagacacagctaatgcgtccgctaactgaaccacatcaaaatctccttccgacatatttgaatttataacagaaatcactttatccaaaaactctttatcaatagaagaaggttctaaagaatcaatattgacttctacattagaacgaaactcttcctgtttgtttttcttatgcattataaaattattaatacgagcctctaatatttttaattcaaatggcttggatatatacccatccgctcccgcattataacattcaatgcgatcttccacggtatttttagctgttaataatatgataggaatgtgactggtttccaaatttgactttaaagcgcgacaaaactctaaaccatccatttcaggcatcatcacatcacttataataatatctatttcattatcttttataacgttcagagcttctaatccatcttttgcaataagcacatgataatgcttggatagaattttctccatcaaaaacaacaattcttcattatcctccaccaataacaaatgaacgtcagctatctgcgtatcttcaccaacctgtgaatcagccaatgcttctttctctaaaataagatccgtatttatgccatttgccgaaatatgttctgatattaattcatcttcttgatagctatctttattaatgggaagatctacagtaaaagtacttcccttacctaattcactttcaacattaatagtgccatgatgtaactccactaaatcctttgttaaggataacccgatcccattagattcactttcatctcctttatttattgtataaaatcttttgaaaacattctccaaatcagcaggagcaataccttctccggtatcaacgacctgtattcgcaaatgatgattttcagactcccaatatgaatctactattaattttatatttccaccattagctgtatatttgtaagcattagataataaattagatactatcttatctagtttatctctatcaaaataagccatcaaatgtctatcttcagtcaaaaatgtaaaggtttgatttttctttctcatcaatggagtaaagtgtatcttacaaacatcatctataaatgatatgacatcactttttgatacagataatttcatgttcccactttccaccttacggaaatctaaaatttgctgtaatagtctacgtaatttattcacattagaacgaatcatagttaactgcgaaatccgactaccattcgtcatttccgcatcatcgatcaaacaagtaataatagttaagggagttaataaatcgtgtgatatatttgtgaaataacgtaatttagtttgcaccaattcttctgacttctctttatctatctgagctattctcagttcatgccgcaactgaatacgacgcttcatcctgtgatagaaaagatacagacataaaagtgtaaacacaatataaaataaataagcccacaatgtttcatagaaagctggctgtttaaacacctgaacttctgctatataattgctccataaaccatttacatcagttgtctttagataaaaagtacgtttacctttaggtaattgattgtaaaatgcaaattgacgatcgcctctgacatacacccaatcatcatcaactccatccattttatatgcatatttaattttgtcaggaaacgcataatttaaagaagaaaaatctatctcaatatttttatctcctgcatttaaagaaatgatctgacttcttaaattaaaacgttggttgtttttctccaaaagactagaaacaccatctatcttgacatctgacaccatcgttctaattctacgaggattatcagacaaatgatcataaggagtaaatactgagattcctttatttcctccatacagtattttcccagaacgagttttataataagaattaggcataaaagaatttaccatcacatcagtcattgtcgagtagtccatgataccaccatttttagggtcgtattcaattacccgcttattggtagaaatccaaatatgtcccaactgatctgttataatattaaaaataccttcttcaagcatatcaaacatatcggataagttttccactttatttgtttgagggtcataagtgaacacatctccatcctgactccccatccacaccaaaccattatcatccacacagattgctccaatattatcacttattactccttctgcatgagttttcaaatttcttaaattcttttcttctaatgtcagatcagaggatattttagcattatacacaccttgctttcttgtactaatccataatgaaccatctttaccttctctaattcctattatatctacaaatggaaatttagtgtcttgaagtatcttttcctttgccggtttaaccaaaatacctttagttgttcccacccaaagattatgattactatcagtataaaataaacgcggaaatcctgaattatctacgtaatctgttaatttcaaagttcccaatagctctactccttttttatccttcttcaccttgtaaatttccggataatactcagaacccagccaaatctcattaagcaatggaacagaggtaatgcagcttacatttttcagattagcaatgttttttagagaagggatatctgtataaaagagaagtttattagaatctggattataaattcctattccccaacgattctgatctatccataaatctccttctttatcttcatatatattctttatatttgtaacaaaccccgtcttttcccgaataacaggaaaagagtaattctgcactaatggtttatttaaatcaatcattgatactccttcattaaaagcagcaatccataagttacctgacttatcttttactatttcactaaaaatattatttaacttagaagaaatatgagatatatcaacagtattaattatatttccaggacgtttttgaagtgcataaagtccctgtgtagatacaatccatatataaccatacttatcatcctgagttatgctaaaacaaccattcttatcccaatgttcattactttttatatctacatgactatacatcaaatcatctttctcctctggataaagtaaaaagattccgctttcccatgttaaaatccaatgttgcttcttattatcttgaaaaactttaaatggattatttaaatctccaatctgaggcatagcaataaatgaatctgtttttgaattatatcgatgtaatcccctttcccataaagttacccaaatattcttatctgcatcttcataaatagaattcacactagtaacaggcaaagtagaatcatatcttttgcaatatgagaaatcggcagaacaacgaaaaacagaagttaatgttccaacccatacccatccatcactatccactatcattgttcgaatctcttgatccttcaaatcattgtgtgtaactggtattatctgataagttcgtttatccagtatattaataccttttttagttcctataaatagatatccatttttattttccgcaatacaagtaatttcattattcgtcaaaagatccggtgatttcaatccagaacggaaaacaagtaatcgatagccatcataccgacacaaaccgtctttagttcctaaccacaaaaagccttcccggtcacaatgaacccgcaaaacagtacttgaaggcaaataattatttaacggaagcgtagataccgacatttgttgcgcaaaggcacacggaaataattgaataaaaaacagtactatataaaatttcagttgatgtttcatagtagaattaatataaagacgtatttcttgtgcaatattaaaataaagatagctatcactattcataaatcacttaaaatatattaatttaaaactaccacaaacatatgtggtctatttttaaacctttctgaatgatttttatcccactataatcagataacttaaaattatacgtatttgaatcattccagcacctatatataaatatgattcagcaattttgcaaacaggaaacaagctattgatatttcgaatcaattttggttatactattcagtaagcaagaaataaacacagattattagttcaatcataaataattaatttataaaacatttctgtatcatgaaaaaaaaatatgtgaagattatgtttttatcattgacattgctgacaattagcacaacagctacttatgcagttcaacccaaagatgataaaaaagaaaatgaagccttacaaacctcaacagaggaacatctaccattactaacgattaatggtacaaacgcatcatcatccttcattgtcaattccgaggctttactcggcaaagaaataacaattacagctccaaacggtttcaccgtaactccgactgttatagcagccaactctggaaaacaaaaagtgaaagtgaccttaaacagtactaaaagactgactgaagggaaaattattctgcgaagtggagacgtccgttcatatttaaaagtaaaaggatatggaaccgctcttcctgtgaaagacattgcagcatctcctgcttacaagaaaggaaatgataaggaatttaccaaagcattcactccaaattcaaaaggatatactatcgaattcaaaataaaaacagatgactcggagaaaagcttttatccttattttgtaaacgaaaaaggttatggattcaaagcatatattacctctaatgaaatcggattattcaatgcctacaaaaaagaaattaccaatcctgcaacaaatggaaaagcaggaggaaaaggtaagttctataataatgatggacaagcacatatttatcgttttgccataacaccagataaccgtgccttcatttacagagatggaattcctgtagattccgttagaattatagactacgctccccagccaaactttgcagagaaagttggcaaaccagtagaaaatcttttaaagaacccaaacttcgaaggagaatttgatataaatccagaaacgaagttagttagtagagtggaaggatgggatgttgttattagcgaccgttggaattcagaacaacaaattcttcctgaagaaattgataataatcaggacctggacaatcatgtttttgaaattagaccctataaatgggcagctggctggagtgatggtatcctaatgcaagtggtagatgttgtaccgaatgaaaattacacactatctgctctattaaaaggaggaatagcaaaaaaagaaggaaaactcaccggtaaaatgattatagaagaagtgcaagaccctgaaaaaaaagtcataacagaaattgccagtgacaactgggaaacttattcaatggactatactacttctgccgaatgtaaccaaattcgcgtatcctttacagtaggacgtggaggatggggaaatgatatcggagctgtccgtgtagacaacgctaaactgaccggcacatcacgtacatactcgcccaaattcggttttatagataatactgctgatgtggaatatttcacaattgacgaatctggagcctatgcccctgcacagcccgaaataactattaatattgaagactaaaataacgaaaacatgagaataactctatttatctgctttatgttctcattcacctctattttttcacaaaacacccagatcagtccgggtgttttgtggaatgacatagatggggagcaaattaacgcacacggtggatgtgtcgtttacgaaaaaggaacttattattggtttggagaagatcgtacaggttttaaatcaaatggggtaagttgttatcaatctaaagacttatacaactggaaacggctggggttgtcgatgaaaacgacaggtgaagccagagaagacatgaatgatatatcgcagggacgtttgttcgaacgtcccaaagtaatttataatccccaaactaagaaatgggtaatgtggagccattgggaaagtggagatggatatggagctgcacgtgtttgtgtagcaacaagcgataaaataatggggccttatgtactttacaaaacatttcgccctaataaaaacgagtcccgtgatcagacgttattcgtagatacagacggaaaagcatatcatttctgttctacggatatgaataccaacatgaatattgcattacttagagacgattatctggagccgactccaacagaaactaaaattttaaagggacttaaatatgaggcacccgctatttttaaggttggggatatgtattttggattgttttccggttgcacaggctgggaacccaatcccgggagaagtgcctacagtactgatatactggggaactggacaacagggaacaattttgctgtagataaactcaaacaagttacttacaactcacaaagctgttatgtatttaaagtggagggtaaagaaaaagcttatatatacatgggtgaccgttggaactctaaggatgtaggaaagtctcatcatgtgtggttgcccattagtatgcgctcaggctatcctgtcgtaaaatggtatgatcaatgggatttaaccgtgtttaatagtatgtatcgctataaaagagctgcagaaatcatacccggtaatatatactcattattagaaaagacctctgatcgtttagtgtctaaacctgccaatggtttcagtatagcggatgatgatgatgacatcaatctaagtctggagtttataaagactaatatacccaacgtatataaaataaaagataccaaaaccggaaagtttttggaatcactgttcggaactttacgcctgaatcccgagaagaaagatgatgctcaatgctgggtgttcaacctacaggaagatggttattatcagatacaaaatctgaaagataagaagtatgttacagtttccggttcaaatacatttgccggaagtaatttatatcttactgaactatccaagaagttaatgcaagattttgcagtatatttcgattccaataaatataaatataaggaagcagatatattctctgatgcctacaaggctaataatctaaaacagatgaaagcccaataaatttctcatatgtaattctgataaattaaatttgttacattatgaacataaaaagccaacaggcaaaaaatagttttttattcatatttatatatctatgtagtctgtctttgcaaccagctttcgcaactcaatcgaaagaagttataacaacagatatctgggcagccactgccactgtattcaaacttgtcggtgaaaaagctgtcaacaatgtaaaactgaattggatgcaacgagaggacgctgacctttatagaatctaccgggatggaaattgtattggagaagctaaaggaaatacatacgatgattataatctgaaagcagataaaacttttacctaccatgtagaagcatttaaagaggggaagaaaatagccacgtccgcttctcaacaagcaacaaccttcacccctaacggcgaaactaaagtttatgataatctaaacggaaaatatatcaccaaagaatctgcccaaaaacctcagggtatgaaaattggggagctttatttctcttataaaatggaaaacgttgaaaaggaagtagatggacaaacactcaaaggatggctagctacagaaagcttttctccgacagggctcaatggtagttggagtacttcccgtgaactggctttttacccaaatgtaaaatttgagggtattgctttccgatataacgcaaaaaccggtaaggtagtactttcagcacattatgaagatcaaagtggatatgttgcagctaaaatctatctggcacaaataactcccaaaggcgagctcgaagtaggcactatggaacgaccattgggctatgactctagagatcaatctcttttcattgatgatgacggtacagcttatctcctttcagctacaaatatgaacagagatataaacatctataagctagacccttcatggactaagcctgttttattagttaatacaatatgtaaaggactacatcgggaaactcctgcaatcatcaaaaaagacggagaatattatttcttcagttcaaaggcttccggatggtatccgagtcaaaccatgtatacatctgccgctgatttaggaggcgaatggacacctatgagagaaattggcaataattctacttttgatgcacagtttaacagaatcagtacagttggaaaaacctgcggagtatggagttaccactggggagcgcaacgaaaatataaaactccggctggcaatttcccgagaatttcaatagccgcatttaacaaaggatatgcttcgatggattattacagatacctggaatttagtgacaaatatggtattatccctgttcagaacggtaaaaacctgacattaaatgtaccggtgacagccgctgtcccaggagcgagaggaattaaagctgattgtatcacggatggagcttgtactgaatcttctacttatttccagaaaagttcaaatgctgctacaggttctccttatatgtttaccatagatatgcagaaagaagccgtgatttctgagattaatctttcgacaagattggttaacggttccgaggctgcctacaaatataccattgaaggaagccgggatggaaaaagttataaaatgctcgtagacggcaaattaaactggcaggtaggatttctaattctgaatattgaagatccgtcgctctacagatatttacggctccgcgtatacggtgttgtcaatgtacataaaaacaattctgcaatgtgggcagatggcatttatgaatttgctgcttacggaaaaccacaataaataagaaagcaaagtgtattagaaaaagccagttaactatttaaatgttgactggcttttcattttgcatcgatcacaaaaagttaccctattaagctttctgtatttaacgattccattattcgttaatatataccattttgtacaagcaaataataaactaaagcccaatcctgatcatttgcatatggatcgtagaatccgccctttactccgttaaccttatttggataaatataggcgcaagaagcttttccatcttcaaagaataaacacagattatttctcacaatattctctgcacgctctttatatgaatgatctcccgtacattgcgaataaagataaaaagcagctcctgacaatgtactccaatagtgtggaaaagtatctccccacatttcccgcttaccaaaccaataaccatcccaatgacgaacagctatttcattcaaatgataactgggttgtttgccattgaaagcttccaatacaggcatttgaatctttgccccatccaaatatttctgccttccggtttccatataaagttgaagcaagaacatgactgatggagctacaatggcttgttcgtagtttacttcactagccggataattcaaaccatttttcaaaaaagtatcaccaaccgcaatataatcattctccaactcttgatattctctttgcatatcagcattttttaaagtttgcagtcctaagcgaaccggtatacctatggcataaaaaccatgtccgaactgtttgaacatagaccgcaaagtcatataaccatgtttagcatattgtttgtcattggttattttatacatctggaaataaaaatccgctacccatacataattgtacgccctgttacgtcccttctgatcgactgaagagaaagtcttatagtcagcatcttgcaatctattacgcaaaaaacttgcatatcgcaataaagatgcctttacttcagcaacaggatgcaattgataatactttgctaaaagtacccccataccgactctttcagcaccttcatccctgtcaaccggattacagttatgcgtattattcagatatatttcattcttttcattatcataaaccatataagcatctctacgcgtattcgaacttttcatctgttgatttgcaactataaactctactcgttttttaatcaaatcatccacactactaatcaccaaacaatttgcatgagtttttttccctgtgccatatagtatatcaaaacgcacttctcctaactgatccattactacttcagcataccatgctgttccttgttttttcataggaatagtgacatcattctttttaagcatacagccttttaccatctgcccacctgatattttcacaagggcagtttctcctttctcaaatacatacttgttgcaagatacccaaacactctctctttccaataacttttgacgaaaatcatcttcacctttatgcgaaaagatataccacgaaaatacctgttcatcacccggcatcaatttcatatccggaagattcaaagaaataattccccttgtatgagagttacccttatttctatcacgctctgatatttcataacttttaatttcgccttccctcaaaaccagtcccaaatgtggagcatatcccccatacgtatcgcgtttacataagctgcattatcaccctcccatatatgagcattagcccgcatatttatacaagtttgtgcccctggatagttatcattgaatggagtatagatgcctatatccgataaaagtatttcctctgttccatcattttggaaagtatactcttctattaaatcttctcctctcatactcctttctacaaggatacatatatctccaactcgataagtaacttctctcccatcctgctttatactggcaggaagattccaaaacaacttgtttttctgatttcttctcacctcagtgaaatagccaagtccccaaccataattctcctttatccaaggatattggctaccatctgttgctatcagccaattcatattctgtttatcattatcaatattcattgattgtatggctccagttttcgaattcactgtaaagtttactttttgggctttaacagaaatacatattactgtcaacaacccaataccacaaagctttaaaaaaggattctttacttttcccattgacatcatcctatttttcttaaaacagggcttacttcttttagataaatctaaatccattgtttttcatttaattaattatagctattaaaaatcttatttccaagtaattattcaaagataattcttttcaaaagggaaaaagtactataatcattcaaaagggaacagtaataaataaaatacctcatccttgtcgaggcaattccccgtttgactaaatttcattcaaatctgttcaattttaattcaatatttcaaaatccggttgattaatcaattgtatatccaagcaggatacacttagagagcaaatagtaaaaagaaaaaattcaatccatttattcgctagaatcaaagaaagtccctatctttaccccaagtaatttttattattcaccattaaatgtaaatattatggcaagtagaagagaacttaaaaagaacgtaaactatatcgcaggagaattattcaccgagtgcttaatcaatagtatgtttatccctggtactgacaaggctaaagctgatgaactgatggctgaagttttaagaatgcaggatgaatttgtcagccgcatcagccatacagagccgggcaatgtgaaaggcttttataagaaattccgagtagatttcaatgcaaaagttaacgagattattgaggccatcgggaaattgaattaaagatcagaatgaagaaagcaatttatagctttatctattaccgcctgttagggtggaagacaaacgttacggtacctaattatgataaatgcgtgatatgtgccgcaccacacacaacgaaccttgatttatttattggaaaactgttttatggagcattaggccgtaaaacaagtttcatgatgaaaaaagactggttcttttttccgttaggaattatttttaaagctgtaggcggaattcccgtagaccgtagtcggaaaacttcgttggtcgaccagatggttcatcattttgctgaatgcaaaaagtttcatctggctatcacacccgaaggaacccgcaaggcgaacccgaactggaaaaaagggttttattacatcgctctcaaggctcaagtgcctatcgttctgatcggtattgactacagtacaaagaccataacgtccactaaagcaattatgccgacgggagatcttaataaagatatgcgggaaatcaaactgtacttcaaggatttcaaaggaaaacatcctgagaattttgcacttggagaactttaagaataaagtaataagtaataggtattaagtattaatcgtagctgctgaaatgctgctccgcatggtatattacctattacttattacctattacttattccctattacttaaaacaggcatcatggattcgattcgtatttccatagtacaaaccgatatcgtttgggaaaacaaacaagaaaatctccgtttgctccacgagaagctgcaaagtctctgtggaacaacggagattgttgttttaccggagatgttttctacaggattcagcatgcaaagtgatatgctggcggaagcaaattccggcgaaacgattacaacactgaaacaatgggcttctttgtttcaagtggccatctgcgggagttatatcactgtagacaacggacgatattacaatcgcgccttctttctgacaccggaaggagaagaattctattatgataaacgccatctgtttcgcatgggacgtgaggcagaacatttctcggcaggcgatgaacgtctgattatcccttaccgtggctggaatatctgtctgcttgtatgctacgatcttcgttttccggtgtggagccggaacgtagccaatcaatatgacctattaatatatgtagcaaactggcctatcccccgccgcctggcatgggatacgctgcttcgtgcccgtgcccttgaaaatcagtgttacgtgtgcggggttaacagagtaggtatagacggatatcggctgaaatacaacggaggaagcaaaatctattcagcgctcggagaagaagcggcttccgtgcccgacgaaacggagggcatagcaaccgctacgcttcatctgaccgcacttcatcagttcagagaaaagtttccggtatggaaagatgcagacgaattccaactccgccattcgtgatgaaacaaatgttaaaaacgatttgaaggtgcaacaatacctagaagttagtagttaattatatagacttcttttgtatctttgtcgtgaaaatacagtcgtaaggactctaatcttacataacttaattaacaactttatgaaaacaaatcttagttctcaaatcactctccacagggtctcccccagatactacagaccggagaatgcatttgaaaaatcagtcttgacaagactcgagaaaatacctacagacatttatgagtctgtagaagaaggggctaactacattgcttgcgaaatagcacaaaccatccgcgaaaaacagaaagcaggacgcttttgcgtactagcactccccggaggtaactcacccagccatgtctattcggaactgatccgcatgcataaggaagaaggactgagcttccgtaacgtgatcgtatttaatatgtatgaatactatccgttgacagccgatgctatcaacagcaacttcaatgctttaaaagaaatgttgctggatcatgtcgatattgacaaacagaatatattcactcccgatggaaccatcgccaaagataccatctttgaatattgccgtctgtacgaacagcgcatcgaaagtttcggaggtattgacattgccctgctgggtatcggtcgtgtaggtaatatcgcattcaacgaaccgggttcacgtctgaactctaccacacgtctgatcttattggacaatgcatcgcgcaacgaagcatccaagattttcggaacaatagaaaatactccgatcagttctatcacaatgggagtatctaccattcttggcgctaaaaaggtatatttgctggcatggggggaaaataaggcagcaatgatcaaagaatgtgtggaaggtccgattagtgacacaattcctgcatcttatctgcaaactcacaacaatgctcatgtagcgatcgacctttcggcttccatgaacttaacacgcattcaacgtccgtggctggtaacatcctgcgagtggaatgataaactgatccgcagcgctatcgtatggctgtgccagttgacaggcaaaccgattctgaagctgaccaacaaggactacaacgaaaacggtctgagcgaacttctggcattgtttggttctgcttacaatgtaaatatcaagattttcaacgacttgcagcataccatcaccggatggccgggtggcaaacctaatgctgacgatacttatcgtccggaacgtgccaaaccgtatccgaaacgtgtggttatcttctctccgcatccggatgacgacgttatctccatgggtggaaccctccgccgcctggtagaacagaagcatgaggtacacgtagcttacgaaacttccggtaacattgccgtaggtgatgaggaagtggttcgtttcatgcatttcattaacggattcaatcagattttcaataacagcgaagacttggtaatcagcgagaaatatgcagaaatacgcaaattcctgaaagaaaagaaagacggtgatatggacagccgtgacattctgactatcaaaggtttgattcgtcgtggtgaagcccgtaccgcttcttcatacaataatattccgctagatcgggtacatttccttgacttgccattctatgaaaccggtaagattcagaaaaatccgattagcgaggctgacgtagagatcgtacgtaacctgcttcgtgaaataaagcctcatcagattttcgtagccggtgatttggctgacccacacggtacacaccgtgtatgtacggatgccgtattcgctgctgtcgatcttgaaaaagaagaaggagccaaatggttgaaagactgtcgtatctggatgtatcgtggtgcgtgggctgaatgggaaattgagaacatcgaaatggctgtgcctatcagtccggaagagcttcgtgcaaaacgtaattctatcctgaagcatcagtcgcagatggaaagcgctccgttcttaggtaatgacgaacgtctgttctggcaacgtagcgaagaccgtaaccgtggcacagcaacgttgtatgatcagttaggactggcatcgtatgaggcaatggaggcatttgtagaatacattcctctataagaaagaaaattcttaattaatagaatataaaacaatcaaagaagagtgggcagttcgatacttcccactctttttttgtttatttttgcaggagattttgccacagaatacaatggacttacatgaacgcgagattcatttcgtattctccttccaaaaggggaaatgccatcaaggggaaagtggcggacatagataatcataggatgcaacctaaagagtggaacgatgaaaaaaataatagtctttcttctgtgcctgacaatgggcaccagtcttctcttcgctcaggacattgagagaaatataaaagagcggttaacggattactttgccaaatacacagcgacagctaaaatcagtacaccgaaactgaacagtttcgatattgattatgaccgcagaaccattcagatttatgcttcggaaagcttcgcctaccagccctttctgccggaaacggtagaaaccatctacaatcagatgaaagaactgctccccggtccggtaaactattatcagatcaccatttatgcagatggaaagcccattgaagaattagttcccaacttgtacagaagcaagaaaaaggataaagaacgaatggcgctgaacaccgaatacaaaggtgctccatgggtgaaaaacacttcccgccccaatgagatatcccgaggattgcaggaccggcatattgccctctggcaaagtcacggtaattattataagaatgacaaaggcgaatggggatggcagcgcccccgattattctgcaccacagaagatatgttcactcaatccttcattcttccatacgtcattccgatgttggaaaatgccggtgccattgtgtatactcctcgcgaacgggacacacaaaagaatgaaatcattgttgacaacgatactccgaatgcttccctttatttggaagtaggcagtaagaaagcacgctggacgactacttccgtgaaaggattcgcccagaaaaaagccatttacaaagatggggaaaaccctttcactgacggtaccagccggtatattcaaacagaaaagaaaaaaaagaagaataaggatcaggcttttgccgaatgggtacctaccctgccggcaaccggaaaatatgcggtctatgtttcatatcagacactacccaatagcgtgagcgatgccaaatacctcgtctttcataatgggggtgtcacggaatttaaggtcaatcaaaaaataggcggcggtacttgggtatatctcggaacttttgagtttgacaaaggaaataatgactacggcatggttgtactgagtaatgaaagtagcgagcatggcgtagtgtgtgcagatgccgtacgcttcggaggaggaatgggtaatatctcacgcagaggaaaaataagcggactcccccgttatctggaaggagcacgatattcatcccagtgggccggtatgccatacgatgtatatgccgggcgtaaaggagaaaacgattatacagacgatatcaatacacgttccaatacaatcaactatctgtcgggaggctctgtctataatccgggacaaacgggtttaggtgtacctctggaaatgactatggcacttcatagtgacgctggatgcagtaaagacgatgaaatcatcggttcgctcggcatctataccaccgatttcaataatggcaaactaaattcgggaatggacagatatgcttcacgtgatcttgcggatatcctgctgactcaaattcagaaagatattcgtacgaactacaatctaccatggacacgccgcagtatgtggaaccggaattacagtgaaacacgacttcctgctactccttccacgattatcgaattgctctctcatcagaactttgcagatatgcagcttggtcataatccgaatttcaagtttaccgtaggacgtgctatctacaaaggtatcctgcaatttataaacagtcagcatggcaaagactatgtagtgcaacctcttccggtcagcaacttcgctatccatttcggaaaaaagaaaaacacactggaacttacctggaaaggggaagacgatccgctggaaccgacagcccgtccacgggaatatatggtatatacacgcatcggatacggaggattcgacaacggaactctggtcagcaaaccctattacagtgtcaaagtagaaccgggacttgtctattcgttcaaagtgacagccgtaaaccggggaggagaaagttttccttctgaaatcctttcggcttataaggcaaaacgtgaacgagagagaatcttgattatcaatggattcgacagaatcagcggtccggctgtcattaacacaccggacaaagccggatttgatctggaacaggatccgggagtgccttatttatccaatatctctttttgcggggcacaaagcggattcaaccgttcacaagctggaaaagaaggagaaggcagcctgggacatagcggcagagagctggaaggcatggagatagcaggaaatacgtttgattatcctttcattcatgggaaagccattcaggcagcagggaaatacagctttgtctcgtgcagcgacgaagcggtagagaatggaatcgtcactttagaagattacccgatcgtagactatatactcggacttgaaaaggaagacccgatagccaaagcatattacaaaacattctcttcaccgatgcaaagactgattacaagctattgccagtcaggaggtcatttgttcgtcagcggtgcgtatgtgggaagtgacatgagcggaacacaagggaaccgggagtttacagagaaagttttgaaatacggttatcagaacagtctgacagacaaaagttccggtcaaatcaatggattaggacgcagcatcacgatcccccgcctgcccaatgagaccagttatgctgttacggcaccggactgcatcgttccggtagctcccgcatttccagtatttacttatgcacgtggcaatcagtcggcaggcattgcttacaaaggagcagactatcgcaccttcgtactcggctttcctttcgaaagcattcagtcggaaacagatcgcgccagcattatggccgggatactaggtttctttactcagaaataaagtactcacggatataagatttattttctgaaagcccggataaaaatatccgggcttttttaattcgtttttcattttaaattctatctttgctcctagtaataacccttaaaactaaaaaacgatgtatactatacaagcaaaccccagcggtacacgcagcatagaggtgtccagcgaaaatctgaaaacaatcgagaaatatgccttattccgccatctcatcgatagtaccggaattgtagacgaacccgtactggataaactgaaactaaatattcgttccctgattgccagtcaggaagaggacagtaaagaattgctggatctttgcatagatgttatttatcacaataacatgaaagcattcggcctgcaacaactcatcaagctctatctcacctggctttccactcaggatgcggaagaggaggaagaataatgattacggtagatacctgcggaacaacagcttacagtcctttgattcctgcaatcaaagctatatgcgaggctcctttcggtgaaacgctcgaaattatcatgaatcatgcagatgctttccaagacttaaaggaatatctttccgagcaaagcatcggttttcgtgaaatctatgacggagagcaaatgacattgcaatttacaatcaatgagaagttttaaaaaaacatcttaatgattgaagttaaacatcccaatgaataaaaaaatcattgggatgttttttattatccgtatctttgcggcatgaaagaatatcgattgaccgattggttacctaccaccaagaaagaagtggaactccgcggatgggatgaactggatgtcattcttttcagcggtgatgcttacgtagaccatccctcatttggcgctgccgtcatcggacgtatcctcgaagcggaaggtttgaaagttgcgatcatcccccagcccaactggcgtgatgacctgcgtgacttcagaaagctgggtcgtccccgattattcttcggcatctctgccggaagtatggactcgatggttaacaaatacactgccaacaagcgtctgcgcagtgaggatgcgtacactccggacggccgtccggatatgcgtccggagtatccttccatcgtatacagtcagattctaaaaagactctatccggacgttcctgttatattaggaagtattgaagcgagtttgcgccgtctgagtcattatgattactggcaggataaagttcagaaaagtatcttatgcgatagtggcgcagacttgctgatctatggtatgggagaaaagccgattgtagaactaacccggaaaatgaaggaactgcttcctgcggaggatgcttcattgacagccggtgaactcaagaaaatagcgggaactatccctcagacagcctatctctgccgtgcgacagagtggactcctgccgcagacgatattcagctttactcacatgaagagtgtctggctgacaaaaagaaacagaccagtaatttccggcacatcgaagaagaatccaataaatatgcggcttcccgtatcacacaagcggtagataataaagtagtcgttgtcaatcctccttatcctccgatgagccaggaagagcttgaccattcgtacgatctgccctatacccgccttccccatcctaaatacaaaggaaagcggattcccgcatatgatatgataaagttctccgtcaacatccatcggggatgcttcggcggttgtgcattctgcaccatttccgcacatcaggggaagtttatcgtcagccgcagcaaggagtctatcttgaatgaagtaaaggaggtgatgcagttgcccgacttcaaagggtatttaagtgaccttggaggtccttccgccaatatgtatcagatgaagggtaaagatgaagcgatatgcaaaaaatgcaaacgcccgtcatgtattcatcccaaagtgtgcccgaatctcaattcagaccatcgcccgttattggacatatacaaatcggtagatgccatccccggcataaaaaaatcatttatcggcagtggagtgcgctacgacttattgctccatcagagtaaagacgccgccaccaatcgcagcacggctgaatacacacgcgagttgattgtcaatcatgtgagcggacgattgaaagtagctccggagcataccagcgaccgggtgttatccatcatgcgcaaaccttcattcgaacagtttgaaactttcaaaaaaatattcgaccgtatcaaccgggaagagaatctacgtcagcaacttataccgtactttatctcttcgcaccccggctgcaaggaagaagacatggcggaactggctgttatcaccaagcggctggactttcatctggagcaagtacaggactttacccctactccgatgactgtagccaccgaagcatggtacagcggatttcatccctatacactggagcctgtattcagcgccaaaacacaacgggagaaactggcgcaacgacaattcttcttctggtataagccggaagaacgaaagaatattctgaatgaattaagacgtatcggccgacaggatctgatagacaagttatacggaaagagaaacaaatgaaaccattaaaacggcttccctattgactttgccttttaaatttcgtatatttgtagaaacaaatccggaatcaaaagcatgaaatgtacaaatataaagacataaagatataatttacatgtatgagagtacattgtaaggaataagaatggggtgaagtccgcaaggattttaccccattttgtttaattaattcctctcattccgaagaatttggcaaaatatagtttataataaacttgggacccgtttataataaacgtcctcactatttattataaacgtgctgcgggtttatgaagcaacttgtataagaaagagaaaacaaaaatcacagatgacagaagaaaagcatcagacgcaaatatattcacacatttacaaagaacaatatacttttactaatgccttcctgttctctttccaatcatgataaataaatcatggggcaaccttttcagaaagaggagccgaattaaaatttatatcctttgtcggagtgatggtattggtagctaactcataaatgaaatacatggaaagagctgtagaatatacagcaaacttagtactaccggttttgttgtaatataatctaaatgtacaaatatcagtagctgaaatgaatggttcatacttcaaatgcgagtgaacaggaaaagcaatcatcggcatttgttctgtagcttccaccggaataagtctggaatgaaatttcttccacgattgaatttctccttttttattagcaataaataagtaatcattgccgaaaggtatggcacgccctttagatactcctgaaatagcatagaatttatatccatctgcaaatggtatgagatcccaattcagaggataattatcgtagcgataaattggatatttttcatggtcagcaagttcactccgtatcttttcttttatcttagccaaaagtatttcctgttctgttaagttcctgcgggtagttacttccgaacatggagctgattcattaagaaaagttgcctcatagatacaataagactgcttatcaatagcaacacatttaatagaatcgccctggtggtaagtcagaatattctgaattgtttcaattaaccccggtttggcaaagatcatatcagtgaaattccaggcagccgtttcatatctgtacaaagtattagcttcttctacaatagaatcacatttctgtttgagttcagcttccgtataactctcttgcgaatacaccgtcaaccacgatgataataggacgatcaatgtcagcatgtttttcatattcattcttttttagattttaaatggctcttacctgttcttatctgtgtctttagatcaaagataagcatttttgaatataaaaaacaaacattgctcttattatttatcaattaatgatcatcctgttcttttaccggcaacgctacaatctcctgcaacacactaacggcagtttccacattagtcacatcctttatcagcatactccgtcggccgttctgctcacgcaggtcacagcgacgggtatatttcatcatgtaatctatcattttgccaaacgcctgactctgatagaacggactatccgcattggagacaaagaataacgtcatacgtccgcccttcaagaagactttctccactcccaatcgcgccgccaagcgacggaggggaacgatgcgaagcaattcctgcgtttccggcggaacaggtccgaagcggtcttccaggcggaaacggaaggcatccacgtctttatccaacgtcagtccgtccagttcgcggtaaagcaacatacgctcgctgctgcccgtcacataggtggccggcaacagaagttcaagatcgctttctatctggcattcgtctacaaattcttctccactgatctgaccttctccctttatttcatctgcatacaattctgcaaactcatcattcctcagttcatgaactgcttcggcaagaattttctgatacgtttcgtaccccagatcggcaatgaagccactctgctctgctccgagcaggttaccggctccacgtatatccaaatcctgcatagcgatatggatgccactccccaaatcactgaagttctcaatcgcctgcaagcgtcgttttccttctgccgtcagactgctcaacggaggcgccagcagataacagaaagcctttttgttactgcgccctacacgtccacgcatctgatggaggtcactcagaccaaagttctgcgcttggttgatgatgatcgtattggcattcggaatatcgataccgctctctatgatagtagtcgccaaaagcacatcatagtcataattgacaaagtcaaaaatgatctgttccagctgtgtgggctccatctgtccatgcccgatggcaacacggcaatcgggaatatgacgttcgatcatcgctttcagttccggaaggttcgcaatccggttgttgacaaagaaaacctgaccgttgcggctcatctcaaaattaatcgcgtccgtaatcacttcctcattaaaggtatgtacttctgtctgaatcggatagcggttaggcggaggcgtagagattacactcaggtcgcgggctcccatcagcgagaactgaagcgtacgtggaatcggtgtggcagtcatggtcaatgtatccacattcacctttagctgtcgcagcttctccttcacagagactccgaatttctgctcttcatcaatgatcagcaagcctaaatctttaaactgaacatcttttcctaaaatacggtgggtgccgataagaatactgacttctccttccttcagtcctttcaatacggctttggactgagctgccgtacgggcacggctcaaatattctacccggcagggcagatccttcaaacgttcgcggaatgtctggaaatgctgataggcaagaacagtcgtcggcacaaggaccgccacctgtttattatcggctacggctttaaacgctgcacggattgctacttctgtctttccaaaacccacatctccgcacaccaagcgatccatcggacggtcgctttccatatcggccttcacctccatcgttgccttactttggtcgggcgtatcttcatagataaaggaggcttccagttcacgctgcaagaagctgtcagggctgtaagagaaacccttttcctgacggcgctgcgaatatagtttaatgaggtcgcgggcaatatctttaattttcgccttcgtacggtctttcagtttctcccaggcaccggtacccagtttattcagtcgcggagcttctccgtccttacctttatatttggaaactttatgaagggaatgaatggaaacgaacacgacatcctcattctgaaagacaagtttcagcacttcctgcgtagtatctccattcggaatgcgtaccaaaccggagaaacgaccgataccatgatccgtgtgaaccacataatctcccggagtaaactgattcaattctttgagggacagagcgaccttacccgaacgggccttgtcacttttcaagttgtacttatggaaacggtcgaacagctgatgatccgtaaaaatacacagatgcagcgtatgatccacaaagccttcatgtatcgtacgtactacaggagtaaactgaatcttatctccccggtcttcaaagatggctctgatacggtcggtctgcttagtgctgtcactacagatataaagtgaatatccctgttcaagatagtccttgaaagaaccggccaccagatcaaagttcttatgaaaaataggttgtacggaagtatggaaagagatctttgcatccggcgtaccagtcggtttattcccaaactccatccggcggaaatcgagggcacgtaccgtaaattcactgccatcaatcagcttgccctccagcgtgataccgccattttcttcggcttcctgtacggcaatagcctgtggcgtcaaagcctcatcgtgcactacctggatacgctcgcgcaaccaaaggaagtcacgcattgccaaaacggtttctttaggaatgaaatcaagaaaagaagttgtcacatctcccgtcactgccaggtcagggactatagccactccctctttcctctcacgggacaactgcgactctacttcaaatgtacggatactctctacttcgtcaccgaaaaagtcaatacgataaggatattccgaagcaaacgaaaagacatcaatgatactaccccgaacggcatattgtcccggctcgtacacataatccacatattcgaaaccatagctatgcagcacgtctgtgataaaagtagtgtccagcttctctcccacattcagtttcaaggtcttatcgctcagttccttgcgggatactactttctccgctagcgcatccggataggtaacgatgcacaaaccttcttctcctttctgcaaccggctcagtacttctgtacgcagaatctcgttggccgcatccttttgtccgtacttgatggaacggcggaatgaagacgggaagaacaacactttctctgttcccagcacttgtgtcaggtcatgataaaaatagcccgcctcttccagatcgcccagtacaaagacaaacggacacacatcttgtttcaccaatacagaagagaaaagagaagcggaagaagcacataagcccccgcaaaaaatagtttgaacggacgcatccttcagcagtcgttccatgactgctgtattaggatgagcggcatattgttgttgcaactcagttattgtcatagctataaaatttcaccgcaaaagtacgaaaaaagaaccgggattgatatagtcacaccgaagttttcttcttcaagattgtttcaagccttgaaactattggtttcaaacaatgaaactaaaagtttcaaggcatgaaaccaatagtttcacaccggggaacaaatacaaacgcgttaaattatccttagtccctctataactaaaggaaaagcgctacatttgtcttaaaaataggacttctatgcaattatcagatagcatcgttattatcccgacctataatgaacgggagaacatagaaaatattatccgtgccgttttcggtttagacaaggtattccatatactggttatagaagacggatctccggacggcactgcaagcattgtgaaaactttgcaacaggaattccccgaacgcctctttatgatcgagcgcaaagggaagttaggattgggtactgcttacatcgcaggattcaagtgggcgttggagcacgcatacgaatatatcttcgagatggatgccgatttcagccataacccgaatgatctgccccgtttgtacgcagcttgtgcaaaagaaggaggagacgtatctgtcggctcccgttatgtaagtggtgtgaatgtagtcaactggccgatgggacgggtgctgatgtcttattttgcctccaagtacgtccgcttcattaccggtattccggtgcatgatacgactgccggatttgtatgctaccgccgtcaggtactggaaacaatcgatctggaccatgttcgcttcaaaggatatgcttttcagatcgagatgaagttcactgcttacaaatgcggattcaaaatcatagaagtccccgtcatcttcattaaccgtgagttgggaacttccaagatgaacagcagtatctttggagaagccatattcggagtgatcaagttaaaaataaatagttggttccataaattcccgcaaaagaaatgaaacgtatactgataaaaaacgccgtaattgtcaacgaaggaagaaaagttccgggatctgttcttattgaaggtgagaagattgctgagatcttagttgacagacaagaggctgccatgccttgtgacgaaacgattgacgcatccggctgttatcttttgccgggggctattgacgagcacgtacatttccgcgatccggggctgactcataaagcagatatcacaacggaaagccatgccgcggcagccggaggagttacctcgatcatggatatgccgaacacaaatcctcagaccacaactttggaggcgctgaatgacaaactggctttgctggcggaaaaatcatctgtcaacttctcctgttatttcggagcgactaacaataattatccgttattcagtcagctggacaaaaaccgggtatgtggggtgaagttatttatgggttccagtacgggaaatatgctggtagaccggatggcaagtctgcgcaatatcttcggaggtacggatttactgattgcagcacactgtgaagatcagggaatcatcaaagagaatacggataaatataaaaaagaatacggtgacgatgtacctttgtcacttcatccggtcatccgctcggaagaggcttgctaccgttcttccgctttggcggtacaattggcacgcgagaccaatgcgcgtctgcatattatgcatatttctactgccaaagaactgagtttattctccaaagcacctttggcagagaaacgtattactgccgaagcgtgtgtgtctcatctaatttttaccgaagaagattatcagaccttaggagcgcgcatcaaatgtaatcctgccatcaaaacggcagaagaccggaaggctttgcaggaggcagtcaacagcggcctgatcgacgctattgcgaccgaccatgctccgcactgcttgagtgaaaaagaaggaggcgcattaaaagccatgtccggcatgccgaccatacaattctctttggtcagtatgctcgaattggcagacaagggtgctttcagcatcgaaaaggtagtagagaagatgtctcatgctcctgcacaaatgtatgagatatgtaatcgcggatttatccggaaaggatatcaggcggatctggttttggttcgtcccgacagtgcgtggactgttaccacagactgcatcctgagcaaatgtaaatggagcccgctggaaggtcatactttccactggaaagtagaaaaaacatttgtgaacggtcatctgttatatgataacggaaccattgacgagaattatcgtggacaggagttaagattcagataaacagcaactcgtcacttataaacatatgattttatcttataagatacataacgtcgccccctacatcaattggatttactttttccatgcatggggattccaacctcgtttcgcagcgatcgccaacattcacggttgcgatgtctgccgtgcttcgtggctgactacttttccggaagaagaccgcaacaaggcttccgaagctatgcaactgtttaaggaagccaaccggatgctggatttacttgacagggattatgaagtgagaactatcttcaaactttgcaaagcaaactcggacggagacaacctggtgattgaaaaagaaaccgatcaattcctaattttccctttgctccgccagcagacgcctaaacgggatggaagcccgttcctttgcctgagtgactttatccgccctctttcttctggcattccggatacaataggtgcctttgcttcttgcatagatgcagatatggaaggcctgtacgagcaggatccctacaaacatttactcgtccagactctttccgaccgtctggcagaagctgctacggaaaagatgcacgaatatgtacgcaaagaagcgtggggatacgccaaagatgaaagtctgtcaatgcccgatctgttggtcgagaaatatcaagggattcgccctgccgtaggctacccgtccctgcccgatcaatccatcaatttcctgttggacgaactgctggatatgaaacagataggcatcacactgaccgagaatggtgccatgtaccctcatgcttcggtctgcggtctgatgtttgcccatccggctgccgaatacttctctgtcggaaagataggagaagaccagctcgaagactatgcccgccgtcggggaaaaagtacggaggaaatgcgaaaattcctggctgccaatctgcaataactttcgtttacttgtgatttttctccttttcgcacgactaactaaccagaaaagtaacccatttaattcatgagagaacgaacaacagaggcaaccaaccctattgaacaggagttcttatcggtcatccgcgaatatgaacgggtgatctacaaggtatgttacttatataccaatcctaacgccccgctcaatgacctctatcaggatgtaatactcaacctctggaaagcctatcccaagttcagaagagaatgcaaaatgtccacatggatttaccgcatcgctctgaacacgtgtatcagctttttccgcaaagaaaagaatgtaccggaaatcgtcaccctcacccgcgaagcggactggatgatagaggaacatgacccgatccacgaaatgctgaggcaactttatcaaatgatcaatcagctgggacaactcgacaaatcaattatcctgctttatcttgaagacaaaagttacgaagatattgcggagatcaccggactgacggtgaccaatgtggctaccaaactgagccgtatcaaagacaaactaaaaaaaatgaaaaaggagtaatcatatatggaactggaagaactgaaaaaatcatggaatgccctggatgagcacttaaaagacaaggagctgatcaaagaggaagaacttggcaaactgataggacatgcagacaaaggtatccatgccattgcccggctgaatatcaaactcatcctgatttctttgccggtattggtcttattcctgctggaagtcctgttgcacggcagactgaatccgatctatatcattatcattctatcgtggattcccgcactctactgggacatcaccaccacccgttttctacaacagacgaaagtggacgaaatgcctctgatagaggtgatcagtcgtgtcaaccgcatccaccgatggatgattcgggaacgtctgattgctactgctttccttcttatactggcagtactctcatttatttattggcagatatggcaatatggaatagccatcattctgttttttatcctgctttggggagctgggctggggctgatcttgtggatttatcgcaagaaattcctgaaccgtattcaggaaatcaagaagaacctggacgaacttaaaatcatagacagttgaccagagtcagatgcttcgcctatttcaactaaaaatttaatatccgtgctgttatgttgcaacgcctatttatatttttacttattttccttattctaccagacatttatctgtatctcagatttatcgttcatctgacggcaaaacgctggctgagaatcctctactggctgcccgctttcctgctatcctcaggattactttatctggtttacttctccaataacgcctttgccgaacgccatacacaggctattggatggttttccatctttttcttcctgtttacggctcctaaactattgctgtctctctgcacgattatcggggtacctttccacaaatggctacggtggccccgaactccctttatctgtaccgggctgacattagccgtgatttctatcgtaatgatcatctacgggtcttttatcggacgcacgcagtttgacgtcaaagaggtaacttattcctcgcccaagcttccatcggctttcgatggataccgtattgtccagttatcagatattcacatcggaagttggcagagaaatacttccgctattcagaagttagtaaaactggtgaatgagcaacaggccgatcttattgtctttaccggagatctggttaatcatcgtgcagtcgaactaaatgattttcaagatatactgtccggactgaaagccaaagatggagtctactccattttaggaaatcatgattacggcccttatttccgctggaaaagccagcaagagcaagacgataatctgaatgatctcctgcaaagacaagccgctatgggctggaagttattgaataattctcatacgattctgattcagggcagcgacagtatcgcccttattggagttgaaaacgaaggagaaccgcctttctcccaatatgctgacctccccgaagcgatgcggggaaccgaaggaatgttccagatacttttaagccataaccctacccactggagacgggaagtactcccacaaacagacatcgatttaatgctggcagggcatacccacgctatgcagttaaaattcgggaatcattctccttcctcttatatctatcccgaatggagcgggatgtatctggaagggacacgtggtttgtacgtaaatgaaggcatcggctatgtcggacttccttttcgcttcggtgcatggccggaaataacggtgcttaccctacgacggtaagcacgctttttccattgatcttcttatgtacctgcacctgaactgaaatacgttcactcatttcctgtacatgggaaatgactccgattttccgtccctgcatctgtagctgctccaaaacttccatggctgttctcaggctgtcagcatccaacgagccgaatccttcgtcgataaacagggattctactttcaaattattgctcgaaagcgaagataagcccaatgcaagtgccagtgaaatcaagaaagattcacctcccgaaagcgaatataccgtacgtatctcgtcacacatatcgcaatcaatcacctgaagcgccagtgtatcgggaacttgctgtaacttataccgtttggaaagataagccagatgtttgttggcatgaagcaataacagatttaaagtataactttgggctataactttaaatttagcaccgtcggcactaccaatcaatttattcaatttagcccaacgtacggcaactgcctgtttttcggtaagttctttggttatctgctcaaagattgttttattctttgcctgctgcaacagacatgcctccgcagtcgataacgtacgttccgtattaagattatcttcctgctgtttcgctatagcctgaggaagctgttccggaaattcaatacctttctgttgctcccgaagttcttcaatgacaacggacagttgtttcatttctccttgcaggccggaaagacgattttgtactccttccacttgtttacgagccctttccaacgcctcattcaattctttttctcttcgggcaacagcagcctcagcttcgtccgcactcttcccttttaataacaaagaacgttcctgtcggagtgcatccaacgctttagcgatcacttcgaatctttgttgctcatcaacagctgctttctgtaaaatagccgactgttctttagcggctgataccttttgcgcagccaaacgacactgtgagacattctcacgcagagcatcacagtgtgtccgcaatttctttattttctcatcgttctgctgccattccgcatacagatgctgataagctgaaatacgttccgccaactcatttaaccgattctgtatatgttcttcctctccagccggcaatccttcttgttgtaaaacgaacaactgttcttttatctgtacctcagttgccctttgatgggttaaatctcgttgcaggacaatgctgcgattatttatctgctgataagcagacactgcggtattatattcctgttccatattccggtaaagagtatccactacctcttgttcccgatgataaggatgtgtcgtacttccacaaaccggacaggcctccccttcctgcaactgctgacgcaatgctttcacatcctttcctaccgccatacgggcattttcataaagccgctgcaaagctttaactacagcatcctgctctgccaactgctgtgtacaagcagtcacttccttttccagtttctctatatcctgcttcgacttcgattgttcttcagtcaatttctttatattctgcaagcgcgtcagttctttttgaattttaccctgctcatctaccaaagaaggataaccaaaagagtttaaccggccaaggcgttcttcattcacctttgtccatgtttccaatgtatccttttcctcattaaggatgacttcaatctgttccagctgcagtgactccacatccgtacgattcaacagacgactcaaagaatgataggaaatccgtaactgctctactgcagatgcagatttcttatcctgatccgccacctgctgacgggcagcctgcaaaatttgttgcgactgtatataccccgcctgctgcgactgtatttgtacatccagctgacgtgcctttttcagatccggctgtatcgcttcccactgcgctttaaaatgaatcagtccttcttcctgaacaaccaaagcatcctgtagattcttttgtttattcagttcctcccgctcttcctgctgctttttcatccaaagagcttcctgcattttcaatgaacgaaccacattcaattgcgcattcagttctgccagcaatttaatccctgccgcacgtttctcaaccaactgttctttctcattttgcaaggttaaaagttcttcctccggcaacaactcaatcacactcatcttactttgaatcattgccacctcttcttgtgcagccttattccgggcaaaaatctcctgggagatgcgggaataaactcctgttcccgtcaatttctccagtagttccgctttcgctgcccctctagatttcaaaaaagttgcaaagtcgttttgtgccagcaatacggtacgggtaaattgctcatacgtcaaaccgaccaactctaccaactgtgccagcaattctttcttcgttccctgaaattctttttccgtatccaaatctttcacctccaacacttgaggctgtaaagaaccactcgccttattccttgtccgtctgaccgaccaccgggaacgatatcgatgtccgtccactccttgaaaatcgacctccgcatatccgtcactcgtcccccgacgaagcagatttctcacatctgactgattgatctggttatctcccacatctgccagattgatactctccaccgaagccgcaaaacggggagccttatcatataatgccagacacagagcatccaacaaagtcgactttcccgctcctgtagcaccggaaattgcaaatataccagccgaagataacggttccaccgtaaaatctatttcaacactgccttctatcgaagtcagattcttcaatcttattgctataattttcattctccttcctcctcttctttacgagttgcggaaatatatgcttcttggaataaatcagtcaggtcggcaggcatttccgtctgataaaccttttcgaatgcagattgagcaatctgcaacggagacatttcctgcaatccctttttccagccatcagcctccttttccactctttcttcctgacgataagcagaaacgatacgtgccagacgatatttcttaccagccaatgcctcttctatttcctgacgaagcataggttccggttcttcaagcaaaaccttgacttccagataaggagcttctccatccacctccggtaagtctcttaatatttctattatttttcccggtgaagcagcctctccacccggcacactgataagaggtatggattgtggacactctatccttctgatatcaaccgcacagccttcatctaaagtcaccatcaccactccgtgatgataatgcttctcggcaaaagacataggaatcggacttccggcatatcttacattctccctgccggatacccgctgtgctttatggatatgtcccaaagccgtatacgctatcttttccgaaaaagtatcgggtgatacacattccaaaccaccaatcactgtccgttcgctataatccttctcggcaatctctgatccggtagcctgtaaatgaccgacagcaagaatagcctgattcgtttcccggcgtgcccacaatctttgcaaaagtcgcgcataaagttctcgaactccttccatatatggatttccttctgtctccactaccggataatctccctgccgcaaaaaaggaacagccatacaaagtacttctgcttccccttctctattcttcaattctattgtcaaatgatcatagtcaatctctccgccctccaatttgcgcactacccctctgacttccgtccgcatcgcctgcaacaaaggcagaggagcttccaaacgcgccgcagagtcatgattaccggcaacaatcacaatttgcagtttcggattctccgcagtcacccgataaataaactcataatatatgcgctgagacgcagcagaaggattggaaacatcaaacacgtctccggctataaccaatgcatcaatctcgttttgtcggatttcttcggccagccaatcaagaaaagccttatgttcttccgcgcggtcgtaaccaaaaaatgtctgtcctaaatgccaatcggcagtatgtagtatacgtatcatatcattatctgtctataacagaagacaaaaataacataatcgcaaagattatgttgtatcctactgctttttttaccaataatcatgtatctttgcatatatataaaaataaactccccatgaagatactatattatatttatcaaatttgtattgctttacctatcctattggtattgactattcttacagcgattgtcaccattgtaggctctttactaggaggagctcatttctggggatactatccgggcaaaatatggtcacaactcatctgtctttttctgttgattcctgtaaagattcacggtcgtgaaaaattacacgggaagacctcttatatctttgtgccgaatcatcagggatccttcgatatttttcttatttatggattcatcggaagaaatttcaagtggatgatgaaaaaaagcctgcgtaagataccatttgtaggaaaagcatgtgaaagtgcaggacacatttttgtagaccggtccggtcccaaaaaagtactggagaccattcggcaagcaaaagattcactgaaagacggggtatccttagtcgtttttcccgaaggagcacgtactttcaccggacacatgggatatttcaaaaaaggggcgtttcaattggcagatgacttgcagctggcagttgttcccgttacaatcgacggttcttttgaaatcctgccacgtacaggcaaatggatacatcgccatcgcatgattctgaccattcatgaccctattcctcctaaaggaaaaggtatggaaaacataaaagctactatggcagaggcttatgctgctgttgagagtgcacttcctgaaaagcataaaggaatgatcacaaacgaagaccaggatcggtaagaaacgaaatgcggggatactcacgcacccccgcatacctaaccagtctttatgcattaatctattaaatcaaaaagtctatatattatgtagaaatcttattgtctggttagacatcatttgcaattcctggaatgtcaaagcaaatcctcttcttatttcttcttctaatcgctctaaagagaagtactctgcttttattccattgattttgcctctaaaataattattgtattgttcatgcaatgtatctggagtaactaaacctccaaaaccatattcccccactacaataaccggttttcgttgtaataccccttcataggctataccccttgcgccaatgataagcccagcctcatttacagcttcacttatctcctcgtcagaaaagatatatctcacctgatactcttgtattgtatctaatagaatacttactctcaattttgcacggggacaatcaatcccgactgcaatagaagaattatattcaatagattgctgtttgtcaccttcccaagtgccaatagcaactgtatgatgactattcattatataaaagttaaggtctagttccttatttactctattactagttctccgtatacgtatccgcctccggcgactttaaattctagtttataaacgcccggagcccatccttctatagagaaagaagttgtttgtccaggagccgttacctgacagacttcctgtacttgtccatccactagtattttcacttcgcccaaaggaactgtgaaaatgatttctacaatattatcatctgtagaaacagacgcactaataggtattacaggaatagaacgacttgtcgtagtcggaacttctccttttaacacaagaggcagttttctctctacccgttctgtactctcaatagcgatcatattccctgcaataaataatgcagctagaaaagataaaataaaacgtactttcataattatattgcttttttgtttcgccaaaagtacggtatgtattcgaaaaaacaaaaaaatcaacccggacaaattacaagaggttaatgaaaagtaacaacctattaatcaacatattattaattatcaatttaacatttacccggacaatccattttttatttctcagaattccttcaaaaaaaggtccaaatcatcttgcggagaaatgcctaatcgacctttaagcctgccttttgccctcgttacagaatcagaagtagtatgaaagatacaacttagctcttcgtgactcaaaccaaatttaagaaaacagcaaatctcaagatcatgtttagtaagagttggagctctttccaataaacgactaacataattccaataaatcaaatcaaacagactaaataacttctgacgctcttcattagaaagttttcctcttaaggtcccctcttttattgccaatagaagccgaaatgcatgtataaatgagcctgaagatatgccaacatttaattcaccccccagttctttcagatgttccgacaaagttttattctgcatggttaaaagaacaatctttccattgagttctcctactttagtacgattttcttctaacatcagattttcctttaacacctgatcttttgatatttgaatatcctctatttcctgctggtatcgttctatttcttcttcattctcttgaatctgtaattcaatctcggctattttctttttgttattccgatttttataataataataacacatacatgcaacaacaaataaaaaagcaatcgtaccccacagaataaagttcgtatatcgtactttcatttgcaaattatcattccgtagtttttcattctcatattttttctgtaaacttgctattaactctcgtgagttaagctcctccatagcattagttatggaatctgctaattcatgataaactattgcctcttcaaaattatcaatgtctttttccaagaaatataaacaatcgtatgcactaatctgcgtatatgctttagaagagttcgcactcattattaaatattttctagcattttctgtctgccccatttgcatatataaatatcctaaagacaaacattccatatatttcttttcttcatctgtttctttttcataagcagctaagaaataacgttctgcttctgataaattttgcatagagcgatacaatatacctaattcatgcaatattgtaatttcagataaataattcttctgtactgctatttctaatgcgttattataatataaggaacagctatcccattcagacttaaacaaataaactctagcaatattcaaactagcactaataaccgaaagagaatcctttaactgcttatatgtagtaagtgcttccctaaaattcgtcaaagcatcatcgtacaagtcctgttttcgatttatcataccaacctcttctgctatcaatgccaacattttatgatccttagttctctcataaacatcttttgccgcaagaaaagatttcaaggcttcttcctccttatccaattcaagcataactcttccatgataaaatagagcctttgcatacattattggggaggtctgagttattgtatagtaattcagagctaatgcaatcaacgaatccgaactaaacttcatatagttcttatccattgcctgcgtcatcagaagagcataagtcgcttgtgactcaccccacaatttttcaggatcatgaataccttttaataggtttagagcactatccggacatagatccatacacttttccacttttgaaaaagtcatgttgagagcgtccgtatctctatgacaggaaactgccaaaaaagaaagaataaagaaaaaagcaatacgaatagaaaaggacgttttcatcttatcttgagttttatgcaaaaatacgcaaaaaactcaagatttatttcttcgaacctacattttgttgcatccgttgatgctcttctatcaattgcatgttctctttggccttcgtcaagaactctcgcaccatcttattactcttaaaagaatagggagcatcctttattatatcatctatttgtggagtcataataggatatggcaaagagctgcaaagcattataaatacattaggtcctaatacattttcataattatccgagatgaaagtcttgacatattgattcatcgctttcatcagtgaatctccttctgcaagtaactgttcatgaacttcttccagatcagcaccatccatcaccatacgggtttcttttctttccagttcaccgatactttcttccattgcattcttctttgcaataaagtcatacaatgctgtgttcaaaggagttccaaccgctttgagatcggtattgctaatagtaataacgatcttgccactttccaacacaaccggcatgacactttcgtcatccatataaagtgttgtcatttgtacagaatcgattttccctttcattgaaaatgatccatgtactacctcagccgagtccagttttgtccattctccatccctcaaagtcttcagatataacatttttccatccagaccatttactgaagatgttccttctatcttatacttatgagtacacgaagctagaaagggaagcaaaagcacaaaaggcaaaatcttattcacgttcattgtttcattaaattctgggtacaaaggtacaactgattcggacttaaaagaaacattttatcaatatttaaaacttgtaagactcttttctttaataatccttataaacagaggtgggagatcatttttttcatttagtttatctaaatttgcagtcatgaaagcaacaacttatgcaccttttgccaaaccgctttatgtcatggtaaagcccgtgggagccgtatgtaatctcgcatgcgaatactgctattatttggaaaaggcgaacctatacaaagaaaaccccaaacatgtaatgagcgatgaactactggaaaagtttatcgacgagtatatcagttctcaaacaatgcctcaagtgctttttacctggcacggtggagaaacgctgatgcgtccgctttctttttataaaaaggcgatggaactgcaaaagaaatacgcccgcggacgtacgattgacaattgtatccagacgaatgggaccttactcacagacgaatggtgcgagttcttccgtgaaaacaactggctggtaggggtttctattgatggcccgcaagagtttcatgacgaataccgcaagaacaaaatgggcaaaccttctttcgtcaaagtgatgcaagggattaatctcctgaaaaaacatggagtagaatggaacgctatggctgttgtgaacgatttcaatgccgaatatccattagacttttataatttcttcaaagaaatagattgccattatatccagttcgccccgattgttgaacgcattgtttcacatcaggacggtcgtcatcttgcctctctggcagaaggtaaagaaggagcattggctgatttctccataagtccggaacaatggggtaactttctctgtacaatttttgatgaatgggtaaaagaagatgtgggcaaattcttcatacagatattcgattctacattggctaactggatgggtgagcaaccgggcgtatgtacaatggcgaagcattgcggacatgccggcgttatggaattcaacggagacgtatactcttgtgaccacttcgtattcccggaatataaattgggaaatatctatagccagactttggtggaaatgatgcatagtgaacgacagcatagcttcgggacaatgaaataccaatcactcccaacacaatgcaaggagtgcgactttctatttgcctgcaacggagaatgtcccaaaaaccgcttcagtcggacagcggacggcgaacccggtctgaactatctgtgcaaaggatattaccaatactttcagcatgtagctccctatatggatttcatgaaaaaagaattaatgaatcaacaggctcctgccaacatcatgaaagcactaaaagacggaagtttaaaaatagaatattaacatcataatttataattgttatcataaagtaatgaacagactaagactttatttattagcgctgacagcgctgctggtatgtaccgtaaaagcggacgaaggtatgtggttattgcaactaatgcaacagcaacattccatagatatgatgaagaagcaaggattaaaactggaagcccaggatttatataatcccaatggtgtctctttgaaagatgcagtcggtatattcggaggaggatgtacgggagaaatcatttcaccggaaggcttgatcctaactaaccatcactgcggttattcttctatccagcaacacagtagtgtagaacacgattatctgacagatggtttttgggctacatccagagatcaggaacttcctactccgggattaaagttcaccttcatcgaacgtatcgaagatataacagatgttgtgaatgctaaaatcgccgccaaagagattacagaatctcagtcattcaccggtgctttccttgaaggactggctaaagaactctatgagaaaagtgacctgaaagataagaaaggcattgttccgcaagcccttcctttctacgcaggaaacaaattctacctgttctacaagaaaatatatccggatgtacgtatggttgccgctcctccttcttctgtaggtaaattcggtggcgaaacagacaactggatgtggccccgtcataccggtgacttctccatgttccgtatctatgcagatgccaacggagagccggctgaatatagcgcaagcaatactccgctgaaaacgaagaaacatctgtcaatctccatcaaaggtttaaaagaaggagactatgcaatgatcatgggattccccggaagaaccagccgttatctgactgtgtcagaagtaaaagaacgaatggaatcaaccaatgaaccgcgtatccgcattcgtggtgcacgcctggctgttttgaaagaagtgatgaacgccagcgataaaatccgtattcagtatgcaaacaaatatgcaggctccagtaactactggaaaaactctatcggaatgaacaaagcgatcattgacaatgacgtattgggcactaaagcagaacaggaagctaaatttgctgaatttgcaaaggcacaaaacaataccgaatatgccaatgttgtgaaaaagatcgatgatctggtagcacaaacagcccctctcaattatcaactgacttgcctgactgaagttttcttcggagctatcgaatttggtaactcaatgttaactaaaacacgggaagctttggttgataaaaacgactctctgatcaaagttcgtctggaaggtctgaaagaaaacttcaaaagcatccataacaaagactatgatcatgaagtagaccgcaaagtagctaaagtactgcttcctctctatgcagaaatgattccggcaaaccaacgccctgctatctataaagtgattgaacagaaatataaaggagactacaataagttcgtagacgacatgtacgacaagtctatttttgctaatcaggctaactttgataaattcctcaaaaagccgacagtaaaagctattgatgaggatctggctttgcaatatgctcaatccaaatacgatcaatacggcaatctccttgatcagctaaaagagctggacaaagaacttgctctgctccacaaaacttacatccgcggtttaggcgaaatgaaattacctgttccttcatatccggacgcaaactttaccattcgcctgacctatggtaacgtaaaaccatatgatccgaaagatggtgtacactataactattacacaacaacaaaaggtattcttgaaaaagaaaatccggaagaccgcgaatttgtggtaccggccaagttgaaagaacttatagaaaagaaagactacggtcgttatgcattacctaacggtgatatgcctgtctgcttcctgtcaaccaatgacattaccggtggtaactccggtagtccggtattgaacgaaaacggagaattgatcggctgtgcattcgatggtaactgggaatctctgagtggtgatattaactttgataacaacctgcaacgctgtatcaatcttgatatccgctacgtcctgtttatccttgagaaattaggaaactgcggccatctgattaatgaaatgactatcgtagaataaatgagaaaacaaattatatttgctattttttcactggcaactcttagcatccacgccgatgaaggtatgtggatgctaactgacctgaaagcacaaaatgcagttgccatgcgggaactcggtctggagattcctgttgaagaggtatacaatgccaatggcctctctctgaaagatgctgttgtacacttcggtggcggatgtaccggagaagtcatttcttctgaaggactggtactcaccaatcatcattgtggttacggagctatccaacaacatagtaacgtagagcatgattacctgacagaaggattctgggccatgaatcgtgatgcagaacttcccacaccgggattgaccgtcacttttattgaccgtatccttgatgtaaccagttacgtaaccgatcagttgaagaaagatgaagatccgaacggtactaattatctgtcgccaagctacctgagcaaagtagcagaacgcttcgccaaagatgaaaatatagaagtcactcctgcaaccaaacttgaacttaaagctttttacggaggaaataaatattatatgtttgtaaagaccgtatacagcgatatccgcatggtaggtgctcctccctcttctatcggtaaattcggagccgacacagacaactggatgtggccccgccataccggagatttttccctcttccgtatctatgctgataaaaacgggaaacctgccgcatattctaaagacaatgttcctttgcaggtaaaaaaacatttgaaaatcagcattgccggagtacaggaaggtgacttcacctttgttatgggattcccgggacgcaactggcgatatatgatttctgacgaagtggaagagcgtatgcagactaccaactttatgcgtcaacatgtacgtggggcccgtcagaaagttctgatggagcagatgctgaaagatcctgccgtacgaatccattatgcaagtaagtatgcatcttcagccaattactggaaaaatgcaattggtatgaacgaaggattagtacgtctcaaagtactggataccaagcgtaagcaacaagaagaactcttggcccgtggccgcgaaaaaggtgatgattcttatcagaaggcatttgatgaaatacgttctatcgttgctcatcgacgggatgcactctatcaccagcaagcccttaacgaagcacttgtcacagcacttgactttatgcgcctcccttctacaacagaaatggtcactgcccttaagtcaaaaaacaaagaacaaataaaaacagctaccgaaaatctgaaacaagccggtgaaaaatactttgcctccattcccttcccggaagtagagcgaatggttgccaaaaccatgctgcaaacttatgccaattacattccggaggaacaacgaatcaatattttcgagatcataaactcacgtttcaaaggaaatatagattcatttgtagatgcttgttttgaatattcgatttttggtaatcccaaaaactttgaaaagtttattaaaaagccaagcttatataagataggtcatgactggatggtacttttcaaatactccatcacagatggaatattgaaaactgccattgctatgaaaggggccaatcagaactacgacgctgctcataaggtatgggtaaaaggaatgatggacatgagacaggaaaaaggaatgcctatctatccggacgccaactcaaccttacgactgacttacggacaggtacttccttacgaacctgccgacggagtagtttatgatgctcatactacactcaaaggagttatggagaaagaagatccaggaaactgggaatttgtagttccgcagaagttgaaggaactatataaagccagagactatggacgctatggtaaagacggtgaaatgcctgtctgctttattgttaatactgataatacaggaggaaactccggcagtccggtattcaatatcaaaggacaactagtgggcacagctttcgaccgcaactatgaaggtctgaccggagacatcgctttccgcccctcctcacaacgtgccgcctgtgtagatatccgctataccttatttattatcgataaatatgcaggagcctcccacattattgatgaactgagtattgaataaatggataatgaaaaatggataatggaaagtccctatgtagggtgacatttccattatccattttccattaaataaactcttctaccatatacatctcatctatcatttcattcattgtttcctgcaaattcaacacagcttcttcaggagactctccgtaagcattacattgcatattcacagtcaaccaggcataatatccgccatctgacgcccgctcaagtacataatctgttttattcagtttcatatcggtaaataattagtaaatgttggtattgaagtaattgctgattgtggagcagccagtttttccagttccagaataatacgtcgttcaccactacgtacccaacgaacgaatgtacgattaggagaatacgttccggcaaaacggagtaaaggcttcaaatcaaaagaatcactgataatccctgctcctgccctcattgcatcatgggcattacaatcctgctcaatatgcgccggaaccatcaatacaggttttcccagatacattgcttcacagatagattcgaacccggcagtggtagcataagcacgacaaccggccatcccattaagaaacttcacatcatctatctgatagaaacttagtgtttcgtcaatcctggtcacctcatctgcatctgctttgtcccagaaaaacctcaaaggaacttccggatatatcgtatgaaactcctccacactatctgcaaaaccagaatttaccatatatccatgaatataatttccttcttccggttgaatagcagttacttcctgccgaattaaaggaggaactaccaccacttgttctaccctgtccggttccatatcattgaaagataaagcaagtttcttcgaagatcttacagctgtcatcttggtgaagaaacgcagcatccgtaattgaaaagagtttttatccggaaattcaaaattctgatgtaaaaacaagtattggtgtccgacgcagacatatggaacggagggacgaaagagtgtgtaggtaagtcctgtcaaaagctcgtagaagttgatcactacttccgcccctgtatccttaatccgctggttaatatagcacatactgcgaaaatattccggaatacgcagtaaattataaataaaacttttctttagattcgctcgtttattatctgccgcaggcaagaaattagggctgataaaacgtttgaccggtgcctgtatattccggttaaaaaatccgggcaagatacgtgatgaactctcaccgactaatacttccactacttcatgtccattacgcaacaacatttcttcaagggtaatagcttgtgtcaagtgtcccctaccctcgccttgtacaataaataaaaatttcatgaggctatcattattagtttatttcttatttatttgtttttcgttatgcaaagttcccttttccagattacaataagatgactctacaattactattttatgaacaaaaacagctttttcccgttatattaataaaatagaaattatatttgcagtcttcaaagactgatatttaaatttaagaaaggaaagattatggaaaagtttgaagatttaatacagtcaccgatacccgttttagttgatttctttgcagaatggtgtggaccctgcaaagcaatgaaacccgttttagaagaattgaaaacaatggtaggagataaagcccgtattgtgaagatagatgttgaccaacatgaagatttggctactaaatatcgcatacaggcagtgccgacttttattttattcaaaaatggagaagccgtatggagacattccggagttatccacagtagtgaattaaaaggaatcatcgaacaaaattgcatataaaaggaaaatagcgaatgaagaaagtattagcaatggtagcttttgtcatgctgagcgttatcgtatacgccttcaatgacaaaccggatgccaatcaaggtaaaaaagaggtaacaggtaacggtgaagtcgtcgtaatggacaaagaaatgtttctgaaagacgtcttcgattatgaaaaatcaaaagagtggaaatacaaaggtgacaaacctgccatcatcgacttatatgcagactggtgtggtccttgtcgccagacagccccaatcatgaaagaattggcaaaggaatatgcagggaaaataacaatctacaaagtcaatgtagacaaacagaaagaacttgctgccttgtttaacgcaacaagcattccattgtttgtattcattcctatgaaaggagatccgcagcttttccgtggagcggctgacaaagcaacttacaagaaagctatcgatgaatttctactgaaataaagagccctaattatagtgacactatccggtcaggataatgacattataatataaaaatagtgacactatccggtgtggatagtgtcaccatttttatatacagaataaagatcatttaaagtatcccacgggatgattcatcataggaatctgactatctttcagtttcaatactttcttcagctgagcggcatccatcgaagcacgtggcactgtagccagtttagccgcagaacagaaaatagaaatattctgagaaacaataccggcatccatggctcccattagttgattctgtatcttctgagcatcaccaaaacgggaaacatcactgattaatactaaagataccggagccgtttttacaaaagcctggccacccgctaccgctccacggtaatctccttcagcaatcagatttaactgatgattctttgcgtcatacaagtaacttccttccgataatatcacatatacgtctacatcctgcttattcatagcggaaggagccgttcgttttccagcatccgaacgattgattccgttggccgcccataataagtctgacaaatcagcaagagttaacgctttcgaagcatactcacgcgtagattgacgttcagacaatgccttcatcaccgtaccagtacgatttaaattaggttttggtaacttaacaaccttatcagcagcaaaagcagccgctgaaagcattaaacaaacgaacaatagttgtacctttctcataattgtggtatttataaagttgataggcaaatataaacaaaaaaggtctgcattcactatagaacacagaccttttaaaagttatttataaggctttattatttcttatctccgaaataacggttgtaaagtccttcaaaacctttaccatgacgagcttcgtccttgcacatttcgtgtacagtatcgtgaatagcgtccagattcaaagctttagcacgagtagcgatacgttttttgtcttcgcatgcaccttgttcagcatctttacgcttttgcaggttagtttttgtatcccaaacacagtcacccagcaattctgcaaatttagaagcatgttcagcttcttcccaagcatagcgtttgaaagcttcagctacttcaggataaccttcacggtcagcctgacggctcatagccaaatacatacctacttcagtacattcacccataaagtgattattcagatccttgatcatttcttcgtcacaaccttttgcaacaccaatcacgtgttcgtcagcaaaagacaatgcaccaccttctacttcaacaacttctacgaatttgctggcaggagctttacacaaaggacatttctcaggagctgcgtcaccttcataaacgtaaccgcatacagtacatctaaattttttcattttcttctcaattttaaattaattagtcaatacgtgtttctttatcttttcttaagcaattcttgcatatacctttataataataatgaacttccgtcacttgatgcccatccatttccagactttcaactttcttcacggcttccggagattttaagtcgtaaatatgtccgcaatacctgcataagaaatgagagtgaacagaagtatccgcatcaaaatttgtattcttctcatcaatcgtgagcatcaatgcagctccctgttccgaaaacaatctcaaagtgttgtataccgtcgttttcgaaagtgtcggcatagaaggagataacgctgtatagatatcatcagccgaaggatgaatgggatgattcatcaaatattccatgatcgctatgcgctgcatggaaggctttatattatgctctaacaatcgttcgtatggtttcataagttctccctcttttcaaagttgtattcattacaattataaatctgatgcaaatatagaaagtcccaatatcatttccaaataaaatcaatattttttttgcagatatgtattactaaattcttccatacaaaaaaggccatcttaataaagatgacctttagacattgatatacctctattttgccttaattcttgttggttttagcctcttcgattattgattcaggtactttttcgcaacggacatatttattcacgtcactatcatcatcttttacagtccaaatcatggaaccggattctagcaaatccgttacgatatagtcattgttccagtcaccattaccaaaatcatattcaccactaataacatatcccagataaggatcgttttctatattaaaagaaccagtaatataacgtgcatacatactgtcaaacttctgatacatttcaaaagtcagttctctacgattaaaagttatatagcaatatgtaccttctgccagagcttgtccgttccattcagaaagttgccacgttccgtttaaattagcagcagtgaccggcaaggcaggaatctctaccttttcatcgtcgtcacaggatgcgaaacaaagcacgaaggcgaataaagccattaatttgaaaatattcttcatgtcttctttttatttttattgttacttaatacagtttacttttatattcaatgttcggtctgacggttgcccttccactccctctataataataggaaaagtaaatgaacgacctttttccacaggaatcagtgaggcgtctattgtaatcacaacgtcggcttcactacccggactgattacttccggctcggtacgaaaagttgcaaactcaggaataacagcagccgacaaacgcaatgattggtttccgctgttaccacacaggattcgttcggaaggacgctttcccgcatttacttcccgaaattctatccggttttgtttcagtctcaatttacccatcttatatggataacgtccccattcatccgctcccggcaacacattacctattaatgtaaggcgtgccacaggcattttgtccgaagaagacagataaacaaaagcattcgtgtctatcgttccgggatgattcttcggatgataagtcaatactacaactctcgtttcaccgggagatatctcccctgtacgtacatctgctaccgcacatccacaagtagttcttacacgggtaagatttatggctttgccacttacattagtacatgtgaaacgatacatttttggagcatcatcttcggttaatgtcccgatattcagcacagtcttgtcaaaacgcagaatatgttccgctccttttatcaacggcggatttatcagcgtatctgttttttcctgtggagtgaaatggacattccgggcttcaaccgcccggaattgtccgatgactacacataataaaaagaatcgtatccaagtaactggtttcattgaatattaaaattacatccaaccattatcattagccttcttgcgaacggtaacagtaatggattgttcgcttccattgcttactttcactgtaatacgggttgcaccggtttttaccccggatactgtcataaacgtaccattgacagatactgaagcgacagttgtatcacccgatgtgcaggtataagttagattctctccattaacaaaatagcaggcaaggtttaaagtcgatgctgcaccttctgctacatacatattgggtactaccatatcagaaccattaccctcaatattgttaagcaacattccggcatccagcaaacctgctcccatcttgcccacatatttcgataactctactctagtagcggaagctccggatgagatgtggttacgatagtaagccttcacttctcctgtattataccagctatcgagtggttttgtagatgatttcaatagttcgacaaactcacttgctttaaaatgacgacgttgtttgacagcatacgacaaccccaatgctgcaactcctgatacatgcggacaagccatagatgtaccatccataaatccataggtcgcattaccgttttgtatccaagtcgagagaatagaaccggaatggattccttcttcccaaccttcagggtcatcttgccccaccggattgtaatattccgtatcaccacctggagcagatatcgtgacttcctttccatagttgctatatgaggccggagtaaaatcggccgctaccgcactgacagatatacatttggaataagcagcaggaaatgcagccattcccgcatattcgtttccggaagcgaaaattgccagtccaccgtctatcaccccattgggcgaaccggcattattgataaagtagtccaatgcatctttttccaacggatacaatttttcccattcttcttccgatcccggaccgggagtatatccttcaatcagattggccaaggaagagttgtatccccagctacactgaagaatgactgcgccattatcagccgcatattttatagcccttgcttcagcatccaaggtaacaccggcttcacccgcaaacacttgacatgacataattttcactccggagtttttggaaccatcgccaccggcaataccgcaaacaccttcgccattattattcatagcagcaatagtacctgcaacgtgcgtcccgtgtcccgtgtcaactgcatccatccacgaaatgattcctgaattgctcacgaaattgtagccatatttatcgtccttatatccgttaccgtcagcatccttatctgcataaagttcttccttttcattgatccacatattacctttcaaatcaggatgggtatacatcacaccttcatccagcacagcaacaatgatagaaggatcgcccgtacacttcttccatgcttccatacaaccgacatcacaccccggcctggaaccatttttcaatacgttctgattgtcaaaagggttattgccactgttattataatgccattgatatgccaatccgggatcggagaaggtgcttcctgtcgtaacagtacgtgttgccgccttctgtcgcaatgcactctcactaacataactccgatagccatcaactctgtaagcacgctgaatgtgactgttagcctgtactttagctacttcgcctaatttagcaagacgaccggcggcttccttcaagtctgtattttcatcaaactttacccgataccacaaatgtaatcctgaagtacgggtacgttcttcatttttagtgtctaccggaaatatacgttcaaaatgatatgtacccagaatatccaacacttcgtcagtagaaggaatcccggaacgggtcatagcccccccacttcttgttgcaactgtgagagcctgatcaagaatctctgtcattgcaggatcgaatttaatcagcaattcaccggaagtgacatcagccggaagctgaacttccgtcccccctgttggggtagacggttgttcgatcacttcttgttccgagcatgaagccagcatcaaggcaaacagtgctgtatataagaaatttttcttcattgttcttatttaaaattattcttgttaatgatatttactctatagccctgctagtctgtagttcccgacaatacaaattttctaaaatacaacggataagcgacaccgctaacaatttgatttgtcccggggtctgtacttccgtaataataagaaaaatcgtagtttacgatatccacattattgaatcccactgtatttccttttgagtttctgccgtcttcttgctgattgaatatcatgctttcgggtccccaatatacaaagtaaggatggaatagcaaccaattaggcaaagcacctgtcaggaagttcaaattaatatgaactgtacgggcaaacggtaacacacgcggaatatcctgcccgcttactggagtctgcttccgatatcttacctgattgtcggtcgtcaacagccactggcaagtatctctagatatcttatccatgaatatggatggcttggcagtcaactcatctttactgaagaaatcatccgattgataagtttccggtttatctgcagctctcaatgccgctctcacctctgcgtctgtaggtaattctccctccaagaagttgtatgacatttgcaatgaaatcagtttatcccaagtcaataacttcaagaaagcttctctttcaggttgtccttgagaaatatcaacatgcagaccgacatccctaccattgtattggttgttcccatcaatcaagctcatatctttcagtgtttccgtagcacgacatccggttaatgtcaaatatctcaagtgcgggaaattcttttcgttcaccacatctgtaactacagacaacgactggaaattattacttgccaaatccaaattctccagtttcttacccaatttaataaaattctcagggagagcatttataccaaaagagaatattgtcagatccttcagatactccaattcgcaaatttcttctcctaaagaaatagtacgtatttgtcggttggcattactctgaactgaaaatgattccaggtatttcagatgacgaatttctttggggaatgtttcaccgtcttgcaaatcaatcattgcataacttacagacctcacacgccctacagcttcagtaggaactattccatcttttatttctttatcagtagcttcccaaagggttacaaaactccagttcatcatactttcactggtatcaaaactcatcatgctctggagtttgctattgatagtaataatagccaatgagtcaccggcacgattatcctcaatcttcatagctgctttttgtgttacagtcaacactacagcatctattttattaccgttattgtccaccaattggtcattctcatctactggaaccagatggatctttgccacacgggtatagggagccacattcattccccaacggaaatccactttaagagtacggggacgtgctcctttgtctaaattcaccgctagatctttatccttcggcaatgtcacccaaccgctacgttctccttctacctctcttttctcctcttcagtcatcgtagcctcttctgcgaaagaataatccacacttccgattttgaaatttacgttagtagagataattgatttaaagtgacggttatcgaatgcatccgaactggggatttccacttcaggttctttcaccaagatttgcttaccgaaaccgaactgtgtaaccgtaaccaagctaggctcacgaccattcattgtgaaacttatctgtgctgtacgcgcaacattcgtcagtgtagagtctatggtaagttcacataccgctgaaccaaaaccgtttgccggtgaaacggcaatccaaggtttagaaacgcgtaccacccattgatcattagatgaaacggcgatcttctctgttcctccttctgcaccgatagctatttcttctttatctaccgaaatgccatcgatccttgtttcgtcgtcatccttacatgaggagatgatccccatgcaaagaattagtcctaatgttattttactaaaatatttcattaatagattcttttatattatcgttcaatacccaaagcatcacaaccacgaatatcttgtgtcttatcatataacagaacatacatacctgcctcaatataaggacatacgctagttacatcaatcgagatgttgggattgtctgcaatatccaatatataaagctgcggtgtcagtttctcgtctactttacggatgtcgttagaaccaatttgcaattggatcaaactagggcaagtagtgataccggtcggccattggcgcaagatacgattgccttccgcatcacgttgatggcgaattccgaaagctttcaactggctactgttcaacggttgcgtcgggaacgaagagaaacaattatagctaacgtccatattgctcaaataaggtaaggtagtcgcccggaagtcatcagacaagctggtcaatttattgaaacgcaaatctatagtagtcagcaaatacgtattcttatagtttccgtcttttggtttcaatgaattttccggaatcgatgtcattaaattgttgctcaggataattgtcgaaatcggagaaccggttgcaaacagttctgtagggaacttctggatttcgttatatgacaaggttaccgttgaggcattaatacctttgtaatcatccatcgaacaactgatgttacgtccctccgaacctattttattatacgagaaatctacagatcccatcacatataccgacttggcattgaatatattcggaatatatttcagcttattatgagaaaatcctaagccttccacttgatcggtaaatgcacagaaatcttccggaatctcttcaatctgattgtagtctaacttaaggtcagtcagtttaacattggtaccaaaagcttccagatgtcttaccttattatgcacacaatcaagtaagcctagtttcaccatcttctgtaaagaagcagatgcgggaaactcttccaaattattataacccatataaaaaatctgaattttaggtcctgtatcctcatcgtcagcgagtcgtgtccaatcagcttttaattgggcagcactaatgcctctgttacatgcaatgttcaatgactgtaattcaggaagatcatacaagaagtccggaagctgcgtcatattcggacagttatacaactctacatccgtgagatctttcaaattactccaactcaattcttcattttcatactgtttggcataatccgagttggcatcttcccaatcgacagcaatattatcataggtaaaaggagaattagcaaaatagataatctgcaacttggtcaaccgttgaatagccttcgaaataaacgttattcgattggtaagattaccgatttgtgtatctttcaatgaaatacggctatccttcttgatcggtttcatttcaggatttctattaatggcatcttgtagtaggtctgacaaattcaagcgttggtcatagtcaaggaacattttcttatagtgcatacgaattctatgctttctttcctcgctcatgtccggagtcagttcttcatctccaaataatctgccgctcaccgtttcgctatgtgtaccgaacgaaagcacttttaattcagttaattgtccgatagcatcgggtactctgcctttggcaccgaaaccggcaagcgagagtccggtgacacgcccattattatccaaatcaacaccgggttggtcaccccacatatcaagttctttgttgaagttccagtttaaactgtgaatagtattgtttatcgtcccactataatatctccaattctttccgtccaaagcttcccaaatggctttcagcgctttatagtctttaatgtactccgccgtttccttcaattggatagggacgttggcatcttttgtcaatttgttgtctatcacagtaaaagattctcctcttacagattgcgtttccaattccgatcttttgataccgctttgtgagtaggtggtatatgctactacctgataggtaccggcaggaagccatacggcagagtcgcatgttgctacacctatatccatatacttatcattggcattatcgggattttggtgttctttagaatcttctttataggtgactttcatccccttcaattctgtggtgacacgattaaaggaattcatcaccgtaacatcgacatagcgaatattgctgaataagtattcgccggctgcacgtgtactaattccttctttcgacaatttaaaggtaacggttccatgcggaactgcatctacagtcaatgctttttccagcaatcctccacttacaactgtcagttcattgtcatcgccggcaggtcctgccaacagtacctcatcaagaccgtcatacaaataatagccgacaatcttataagtaccggccagtaattgcaatttgtcactacgcagaccatattccgcattgttcgcattgtatgcgttcagaagcagagtttgtgaaacggtggtaccgttatgcgtcatcaccacctttatcttctgtgcactagacattgattcaagtttgcccacagcacgagtggttgttcctttctcaaaagaggtactcttatagagtttaaactgcacataaccgtattggctttgcagctcctcgtcatcatcggaacatcctgtcactaccaacattgtcagcaggccgacaataaaaggcaggaagaatattgagtatattttatgtagattcatttataatctattattcgttataattattcacaagtaaaatatgcattatatattgataaccagcatatgcttgctaccgtcttctccggtaattattaaaaatacagttttagttaaactgcttccattgcccaaccatacattcaaattttgctttccggtactccaatcttcagatatttcaatatctgaagatgcatcaactatcttttcgtcaacatcataacatttgaaatcaactatactggatgtattaagtgtcacaaatatagactccccaatcggcggattttttatatcagaaatatcagttacctcatattgggtaatgaaataattagcacctcccatactaccatcataagctgtacaactcacaggagctaattggctggtagttacagtaaagggcacatctcctccaccgccacttccggcattgctgattctgacaatcaacatcagtttatttcccgattcatcagagactattaaaaatacatctttaccgtttgcagcctctgtatagattgttatgtcagtttcgcttattggttcagtaacgccattggcctcttgttcatcttcaaagtaatagcaaactgaattgctccaattaaaaggcatttttgccacagtagcgactgatgcaggctgttttatctcaaaaattcctgtcacgccatactctgacttaaagtaatctgcatcgccacctgtataagacgtacaatcaataggattatatgtttgaccgtctaccgcagtaatggctagttcatcgccaccgcctttcgtttctttctgagtaaactgaagaacaagattagactgctcatatttataaaccaaatcttcaccgtcaatgatggtcgcttccaaattatctttgatatcttcatattgagcacgtgagaagacaagaacatatccaactctttcagccggttcgtacgaagcaggagtatattcgtctacaataagtgtcgctttaccaccttcacgttcgcaacgcatccattcattatagctggcatccatgatatacaaatcattattgttgcttcctttttcaacgaatactacctcataatcatcgttcaatgttttaacagtaaaaggcacacgattcttaagagtcgtagtactgcctccggtacctgccactccacctgcgctctgagtaaaagtctttccgtccaaagatacagcccaatcatacttattagatgacggaagtgtcatttccagtacacccggagtcataccatcataagaaacgttgaaagaatagaatgcttttccttcttcatccgagaacgttatcacatttttatctgaagccggaaccggatatttttcacggttatcatcttctattattttcaagccaccacttactttctgattaaccggaccaacaagagaaccaccttcgagttccacccatcccggcagattggtagcagcaaagcggaagtttgcttgcacactaaatttagaaaagtgttggtatcctactttcagttcgttaatctctactccttcttcatcgaatattttcaattcatatcctgctgccgagcgcgtaacctcaccgatcacaatagtctgaccacccattgttaactccaacttagccacacttgcgttatcgttattttggttttcattagtagccatgattgttacggtttgcgttccagcagttccggatactacaaactcttccgtatcgttgttctgaaacttacaccagattgttgatgatgccaaactccagttagtattagccgtgaaagtgaactcttttttctcgcctgcattacagacaatattttgtttttccggaaatatcggagtcaccgtatcatcatcatcgtccgaacatgccgtcaggcagaaagtcataagtaagccaatgaagaagcagctcttgcacaacatcttcatgcaagaatctcctagtggttttaaactaaactttttcatatccatttatatttcttgtttttttaatatccttgttcttttaatttctccgcttctgcttcgcttatccattcgatcacattgacaaacgtgccaaccgtaccgtatgatgatccatctctattgttcacgcttagcgtgacatactgtaggacgaaattttcgttagtactgaagtaagaagtataagcggtaggttgattcatcagcaacttgccatcaccgtaaatagttccgaaagccgttgctgtagatgcacaaagctgttcatccatttcaactaggggttcttgaacatcctcacggttgaaagtgatttccgtatcgtatccgtcatagtaaagaccatgtatggcaatggtattttctttgccttctacgatatccgaagttaccaaacgcaattctaaattgttcaaataacttgcaaaataagtcgaactgacaacacaataacctgtaaagtttttaatgtcaaacggacggattttctgcattacaacttttgcttcagttccatagagtccccattgttccgtttcaggaattaccagtcgcaatgcaaaacccagcgaatcattaatttccagattatcataaataccttgtacctctaaattggtactcctttctcccgccttaatggtaacggtattcgacagaattttataatgcttaccttccacggcattactttcgcgatcaattacttcgacagcgaaggtccggtcatgatcggcagccacagtagcagagatcggaacattgaatatctcattcgtttcttgcacggcatacgtataaagcgtgtcagaaaacataagataactgggtccgttgtatgccaccttgtcctgatcgcatccggaaagagccatcagagcagcaacggctgctatacatcctaataataatttcttcattatcatatgcttttaatctatttgttactttcattcggttgaacctgcgaaccgggagcatccagttcatgctgcggtatcggccatacaaataatggatcatctgcttccactttcaagctgctaccgttagccagtgactggtcttgcggcttccgttcgaatcctttatgccaacgttttaaatcatggagacgaaaaccttccatataaagttctttcacacgctctgcttcgataacttccattgcattggaagcagacaaagcagtagaaccaccgtaagttgaataacgtgctgtacggagagtcgtaatatcttttcctgcacgaccatagtcaggttgcgcttgctgcacataagcttcagcacgtatcagatattgttcggacagacgaagcactttaggcatagatacgtgaaggatctgggcatttgtaaattcttcattgcccaaatacttaatcaacaaaggccaggaaagaccgtggctatagccggtagtgtatgtttgaaagaaacttgacacacgtaagtcgttactatcatacgaattgatagcccaagttgccggtacataatccggacggtagctactgtaatcatagttaaaaaagatctgccccaaactaccaccataagaatttacagtaaaaccaactttccagatagcttcggtagagaggtcgctagtccacatatatttataatagctgacgttttcggacacataatttgtacaactggacaataggtaataattactgtctattactttactggaatacttaatagcttcatcccattttctcatataaagagctacacgtgcacgcagtgcgtatacagtatattcattaaagaatgcagcagtgttgtacaaagcatctttgccggtaggctggaagtctttatccaatgccagtaactcagcagcaagatcaagatcgtctaagataaactgataagaatctttcagcgaagcacgcttcatttcttcgtttcccttataatgtctagtcaaaataacacccaattgattggcagcatcttcatcgctttcataagccttgcagaaaagtttaaccagttccgaataggcaatcgcacgggcaaaataggcttcaccgcaacactggtcaatcagatccaaatcatcatcattagttgtgttctttcttacattatccacacggtcgagcagaaagttacagcgattgatcacattgtacaatgcagcataaacaccttcaatattggtattggttgccaatatgtctttccaacgccagatttctccgtaaatattcgtattaccatttactccatacactaagtctgtctgcaaatcgggcagcaatgtaagactcccggaataaagagaactacttttaaaagcatcatagatacctatgactgctagatttacgtcatctaccgtttggattgcctcatcgaaaggtatagaatcttcaggcatcttatccaaacatgaagtagtggataacaccacggcagccaacaagatatataatttaaatttcttaatcatctttcttttatatactattagaatgtaacttcaatacccaaagtgaattggcgcgaagccggatactgtgctctataaatattgcttgcaacttcggggtctagtccggtgaagccggtccaagtcagtaaattctgtccttgcaaatagacacgtgcagctgagaagaaattagttttcttcaaccacggctgcggaagtgcatatgccaatgtcagattcttcaaacgaaggaaggaagtgttttcaagaaagcgatcgtccaatctcgccaccacgtcgtagcggggaatatcagtaatatcaccgggctttttccaacgatcatacaataatcgttttgactgattataggcactatagattccgttactctcttcaaagaagcggtcattattcatcacgtagcgtttcgccatccaactaaattgagctgacaacgaaagacctttccacataagagtagttccaaaaccacccgcccatggagagtcgaatgtcttaccggtcattactttatcttcttcacggaattcagtagtcagttctccgtcagcagtataccacaatgcatcgccattggctggattcacaccggcataacgattcatgaagtattcgtgtacagaatgtcccactacgtatttcaatccggtagtagagttaacatattcttctacaccgttgtagagttccaacaacttattcttattataagagaaatttgcactaagattccaagtaaaatctctcgtacggatgacgtcaccatccactgccacttcaacaccccggttcatcatcgcaccgatattatcccaatgaccggattcaccggatatggcataagactgaggaacaaacatcaacatattagtggtcttcttatgataaaaatcgaagtttacattcactcgattaaagagtccgacactcaaaccgatgttgttagcccaagtctgctcccagcctagctcttcgtttccactctgcaaaggaaacagaccagcttgatcaaggtagttagcatttccagaaacaagcgccagatgatcgtagtcaggaatagtggagttaccggatgtacctgtgctcaacttaatctgagcaccagtcagccattccacatctttcaagaaagcttcgttttttatgttccacataaagcccaatgaccagaaagccccccagcgatgatctttaccaaaacgggaagaggcatctgtacgtgcagcaacttccgcataatacaaatctttgtaattgtactcggtacggaagaaaaacgacataaaagaatgggctgtattagcatcttgccatgaagaagcccgtgtaccggcggttacatttgtcaatcggtcaatggtctgtcctctcgttactacttgaaaaccggtcgaacgatagtctatcccttcttgtcccaacataaagttaaatgaatgatcctcattcaatgcccatcggtaatttgcagtaagagtttcagtcaagtttagaatatccgacgaactgcgtccggcccttcctgaattattattaataatgtagctcggataagacttcataaaagatgtagagtgagcataatcagcaccgaattgtgcccggacagtcaagttcttaacaggagtaatatctgcaaaaacagttgacaacaacttatattttttatgttctacagggttatttgccatccactcaatagggttctgtcctgtccctttccaagttccgtcattttcagaagctaaagagccatcagcattataaggattccagtaaggcaacataaagcgtgaaccggaaataggagtataaagtgccatatctccttcttcagcctgcgctatttcctcataagccatcatcgtattggtacctatttttaaccagttgctggcttttacctccgcattggcacgcatgttataacgacggaaagttgaactttgggcaataccgtcctgatcgtaaaatcctcctgagacatagtagttcaaacgatcggtagcacggttaacagacagttcatagctctgcaacggtgcacggtcgttaaacacttcatccagccaattaatattagtgcgggaaagcagattgtaatctttaccggtatcctgacctatttccttttcaaattggatacgctccggtgtattcatcatcatccagttatcattcgacgccaattgtgagaacccccactgtccgcgcaatgtcacttttgctttatccattgccaatccgcgtttagaagtgataacaaccacaccattcgctgcacgtgcaccataaatagaagtggaagaagcgtccttcaacacagagatagactctatatctcccggactgatcgtattaaagtcagcactggaaataggcacaccatccaaaataaacaacggtgccgtacccgaattaattgaattcgtacctcgaatctggaaaacagccgccttactaggttctcccgagttagagattacagataatcccggtgtctgtccctgcagtgactgatcaaaacctgcagcaggcacattttccattttttccgctttaacagtggatacggcaccagcaatcgtcccttttttacgagttccatacgctactaccactacctcatctattaaagcagcatctgaaaccagacgaacattcagtgttccggttttggcactaaccgcatgtgcctgtgattgcataccgatataagagaacagcaaagtagcacttgccgtacccttaatctcaagagtgtaattaccatcaatgtcggtaattacaccatttgtagtacccttctctaaaatagacacaccaaccatcggctcattatcttctgccgaaacaacatgtccttttaccttatatccactctgtgcaaaaagcataagaggaatattcagtagagcaaagagtacaaacaagagaattgattttctcatctttgatacttgaatttaaattaatgaattgatttattttttacagatttatctacaaaacgaaaacttagcatattacgcttcacgcatgaaacagcaatatacttctccccttggagcgactttgaaaagtatacttttatcatcgttccaggacagactatcaaatagtctatacaatatatagaatagggaaattagcttggctggtttttaatattacgccatatgtctaaataaatgtcttgtgtcgctgcaatactaataaagtgtatgtccatctctctaaaattatagatattaacccgttggcggaattaatttaagttgataaatatgagtaaaaagttgtacatgtcgctgatttttagtaacttagataaattctttaatattcaataagtttgctcactttataagtcttgcactttacataacatattacttgtcataatcaaaattatgataagctactcataattttgaaggccatcacgggtatggggattgtagactatgtgaataagcagcgcattgagcagtcaatcgtgttacttactactactaccatgaacattactgaaatctccgaagtggtcggcttctcttctttgcgttatttcagtaaggttttcaagtctattaaaggagagattccttccgcttataggaagcaggataagtaaatcgcattgataacttggacttaggaacatatactagaaataaaaaaataaatattagtctcatactctcattctatatgaggtaaatagcatataatcagtgtgatatacaatgagagatacttcttctataaggtatctctcattgttttctacgcaaaatgccttcaatttagcttatctctcctccttttttgctcatctctcattccctttccttgcgtaagtaggtaaaactgtctgccttttgagggttaatatctcatatatcagtttcaaataataggtactttgtagctcggataccttatatctttgccatatcaagcctatatacttatgttttcttaccgacatcttcatcgttccacccgggtgaaacgatcttgccactagagtggagaaatctgttcactctagtgatgagatcagatcactcgagtggaacgatgaagatctcctattaaaaatctgataacaataggtgaaaagcacaacaggatagggtcttctgcataagagaaagcggtatatctcgtctattccatcatttctctgcctacaacgtttatgagctttaagtcatagttatcattgtgggcatcttggaataattgccagatcatcacgccggcatagtcgttttctttgatgaacttacatttgttggctatagtagggcggccgttataataagtcttgcctatattatccttgtccgctgcttcatttccaagatgtttgagtatgccgctatagcggattccacgaacgtcatccactgcgccttgcagactttcctcccaggaatatccataaaaaggaagtcctcccactattttacttttggatgcccgacattgttcattccagtatttgaggtctttcacaaagtcatcgtatgaagcatgctggaccggtttatcggtaaacgctccccggtcataactcatcaggttgatatagtcgaagtattgctcccattcggttccgtaattaagccagcggctgttgacggcacaggtcatcagcatatttttctcttttgccaggtataaacctctggcaaaaaccaataatgaggggaaattcttatcccagttgtcatattcctcataatcgatgtcgaagccgtccagtttatattctttagtgaatgcaataatctgctgtatcagttcttttctggctttcggatcattgatggcggtagtgaattctcccggactgttcttagccaaagatatcagaatcttgacattatgcttgtgagccgtttcacgtacactttcaattctcttccggacaggattaatgtttagagtgccgtctgcttttactcttgcaaagctggcattgatatgcgtcagatatttccattctatcgtaggaaataaactttcaaactcccagtcgtcaagcgcaaggtagccgataactactttctgggtgacttccggttggggctgaggctgcggttgaggcacattgggcacctgtgggttgttggtattagaagagggtccgcaactagtgaataaaatgcttacagccgttaataatgcgtataatacatgtttcatgtttaataagtaaaaaagatttaatacccgaaaacaaatagaggaatgaaagttttgaatagtctctatacttccattcctccttctttagaagttcctaaaaaccttggctcctaccttaaaacctatttatctaacttggttatttttacccagtcaatttccatgatggcaggtaagttggcatcatcgataggacctgcccatgagcccggtctgtctcctcctaatcccatgttcaggatgagatagaatgaagaatcttttgtgaacggccattgcttcatttctgcttcattctccagtttcaggtttgagtaagagaaagtctcctgtccattgacgaagaaagtcagtttgtcttcgctccattctaaagcgtagatgttccaatcctgataattgcaagttacttgtgcggtgttggacggatctttgatgttcaaatcatacgtgtagtgagtatgtatcgtatgatggatcgcggattcctgtttcacatgttccatgatatcgatttctccgcaattcggccatccgtcatagatatatttcttcggcatcatccagatagcggggaatgcgccattggggtaactggtgattttggcttttacttccacccgtccgaaggtgaagtcaaacttaccttgcgtttcgataccgccggctttgtattcatcacctattttttcggctttcagtataagtctgccgtcttttacgtaagcctggtcataactttcggacatttcgtcgttccagtcggagcctgctttctggcagagtacccatttggtcgggtccggattgccgtccacatcgaactcgtccatgaagagaacgtccttcatggtgtcgtcaaacttggtcagtacgatagtataggtcgttgtttgattgtcttcggtggtgacggtcactgtctgctcttttttccagttgtgtacaaatgttgccgggtccggtgagatggtggctccatcgctcattagcgtatagtctacgccggtgatggtattggcatcctcgatcgtaccgatttccactctgtgggttgtctggtctatcttcccatgataataggaagtcgtattcgctgacacattatttactgctacggcaaaatcagtgagcggatatttcttttccggagtgatgtaattggtctcatcatccgaacaggcagcagtggaaaatccgatgattgccatgttcagtataagtaatatttttcttttcatcatactcttttctttttattgatttttgagtttgttagaagcgattgcctgattgggggagttcaggcaatcactatccttagagaattagtctccccatactagtggagcgatgtattcccatttagtcagtgtggcactgccgccagaaattgtcatcgagaaattaccaccatctttggtatccgagaatggtactttgtaagtatcacttgtaccattagcgtctatcacaccgtcgctggttgcttttcctatgactgtaccgttgagaatccattccgagtaaatccatgattgagttggatcattggcatctatagcttcgcgtatctcgaatgataatacgtttggcttgctggtatctacatcacggccgctgttctcattgtatacgtcaccgttccacggtcttgtacttaattgagtccgtttgctcagaatatggaagcgaagttctacgtctcctccgtcaaatgcttttccgctccaagagaagaaagtagtcagactggcgtcgccaagcggttcccaatagaagctgtaatgacccggcattaaaccacccggtccgtagtaagcaccgctgatggatctgtttacttcagtaaccacaggtctttgtggattcgcttgtttaatcttgattgtcttcataagcggagtagcgccttcggcagctttggtgctcagtacgataattccggtacggacagaagagccttcgtgtgcgtctacgttaatcacgatgtcggcagaaccgtcgaatgaagtcttttcgaagtgataccaggtatcatccgcttcgttttctttggatacttcccattctgcattcgattctacgtggatggtgagttgctgagcctgttcatacatagcaaaccacttaccgttttccggtgtatctggtgtcagcaatacaccgtcttgtatacattgtacttctctggctattttcccgtgtcggtcatagatggttacaataccggtacgttgttcgcctgtattcggtgaagcggtgacagtaatttctccgttcatttcgcccgatgctccggattggatggagagccaaatatcaccgtctgttactttagcagtccatttctgattgctgagtacgctgaatgtttcgctgtttccttcctggtcgatcatatccacgccttctacattcaggtaagcagtacctttctgggtcagaacgaatctttttccggtccagtagtcacttttaatgttgagtgtgtctatacggtcgtccaattcagtgttttctttgcaggtaacagttacggtgtaggtctcacctgcctcacctgtactgggtgagatggtgtaccaatcatattttccgaatacttcccacgggtcagttgacttgacctggaaggagactggttccggatttttcgcttcaaccagataggagtcttctactctatagcgcaggtctacccatttctctgcttcactgtcatcgcaactctgcaataaagagaatgcaggtagcaatgtagcgagagaaatgcctgtaattattgattttctgatatttaatctcatactcttgaattttagggttcggttattattctactggttcccatgtgatagacttcacggtgaaattggaagctttatttgtggtatgcatcctgaagtatacaggtgctcccggttcggttgcataaggatcggttatgttattatctaatacggcaacctcaacaccatcaataatcagtttaagaactaatgcgttcgaaccttcttctttgttgacaacaaggaattcaatcttcttcactacattcgtttgttccgatgtccaggtaaatgttttctgagtccagtttaagcctgaacctccacaagtgaagttactttctttatttgcgtagaaatgcaaatggaagtttgtatttcctgagttgggccacatattaaactcaatccaatcttctccggttaaattgatagattcgaaatcgaatgcgagacgtccttttttgaataaatagttggtgactattccactgccatagagtgtcatgtaaccggtttcctcatccacaacatagttatctgctcctccttctttccagaaagcagtaccttgactgatgtcgaacgtaatgccgtcaaatccgtcgatgacttctttggtcttcataatgatgtggccgacacggtttaccatcagattattagtcgttgttgtcgttactttcaactctgtttcactcagtgcctcagctttcagccaactctgatatttcttaggaacttcaactttccattctttgtttgcgcgaatcagtacagtcttttccataccactgcctgttccgggcatgctgattgttgtactttcgggatcttcttccagttcaatgatcactccattctgagtaatggtaaaggtgtattcttcaaactctgtttttacagtcagcgtgcctgctctcttggcacctgcattggcgggcagtgtcacagttacggtttctgctatggcatcttcattacctgtaccggatgttttgtcgatattggaaaggaaagcggtggaaggaatgatttcccaagctttgttggaagcaatggtaaaggtgatgctgccgccttctgtcggtaccagttcatcgtaaggaaccaccaccaagtcttctttcgaagcctgctcgatagtaactaccttagtgccttcaacgccttctgccttgatagtcagtttggctgtacgtgctttctttcctgtattgttttccattgtcaccacaatctccgacaccaatgaactggctgcactcatcgaaggagtcggcttacaccactgctggtcgctttcgatcgtccagggagtgttggagctgatgttgaaaactacattgcttggagaagttgccaaagcagtgtaagactccagagcatctatctggatattgagagggccttccggctgtgagtcgatgtcgaactcctggcatgctacaaaactgaatgtgcacagtgcgagaatcagttgcattaacgtgttgctatataactttttcatatatcttttaaatattagattagacaattaattaccatcctgtgttttgaggatttaagtttgtattcttgtatagttcgctttgagggatcggatacagatacatgcaatctctccagttacgggtttcgtaaaggttcttgtagaagttgaacgtaccgtccgcctgcttctcgatctttactccgtatagttcccgctgggtagtatcggcaatcttccatctccgtacatcccagaaacgatgatcttcgaaagcaaactctacacgccattcattgtacaggcgttccatgaattcatcttttcccatggaaggaatcaacggcatatcggcattctttctcacttcattgatagcccacagagcagaatacttataagtctcatctgtgtaattgacatcattgaaagcgttgaccatagattccgcatacgttagtaatgtttccgcatagcggtaaatcacccaatgatgcttgctgacagcttctttacccggttcaaagctagtagcttcctgaatgtacttgcgcaggaagtatcctgtcggtgaaccgccttgtgatacgattccgtcgtcggcgccacctttgaaggtttcaatggtgtagtctttaaacgacattccgttggcaagaatagcgcggtagaaacgtttgtcacgattctcataaggtgattgcgggtcaaatgcagggtcttcgcaaacccatcctgtgttttctagggttactttgtaaccgttgactgtctcgaatgcgtccacaaggttttgtgatgggtaattgctgtatgggataagactggaagtgcgtgttcccgcagtcatgcgaagcgggagattaaacatttcgaagtccgagtcatcaccattgatcctcatcagtacaacttcttttgagtcgaggttgttggcactctcctgggggtcgagagagtaaagccctgtgttgataatatctattgctgctttggcagactttttccacaattcggtatccatagaaggattatgtagcttactggcagcatatagcagtgcttttgactttactgccattgcaaagcctttggtcactctgccgatttctgctcccggttcgtttacatagctgtccggcaagttattggcagcgtcgtcgcattcactgacaatgaagctgataacttcgctgaatggtgtcttgccgattgtattggcttcctcttcagtcagtacttccaatggcatggcgatgtcaccgtagcggcgtgccagttcaaagaagtagtgtgcccgcagcactctggcttcgtaagggaaatatttcagctgcttcatccagtttgtatattgtccgtcgtgctcgtagcgtgtgaagtccacttgggcaatctctgctataaagctgttggcagcacgtataccgcgatacagggtccatgaatcgtcataagttttaataggcgaccagttaccgttattggtattctggatattatctgcataggctccgaattcgccgtcatcactggcacagtcgcgcatggaatatctgtcttcggtgaaaattccgccggaggtcgcaaacagttggtagccttgtggcatgtatgagtatacgtgggtaagcattgatttgcttgtaccgaaatacttgtacatgtcttcttttgtcttcaggttgttcgtttcatcaaagtcaaggtagttgcacgaagcaaagaccaacgaagacaaaatggttaagagtatgtatttggttctcataatgttcatttgttactttgcattaaaaattaagtttgatacctgcccaataacttcttgtcgacggataagcgatgccaagttgttccggatcggcaaaatggatattgtctaatgagaacagattggtgccttgtacgaatactttcaggtcggcaaagcgagtctgcgatttcgggaaagtataagctaccaataggttacgcagtttcaggaatgaaccgtcacggtaccacagtgagctggcgcgatagttattcaagttttcttgagtagtcagtctcggcatggttgcattggtcttattctccggtgtccagcttatttcttcattcaggaatgtatttgaaatgttgccattgcttacaagtggactataaagcggactgttgagcaatgaaacagtgactccggtcattccctggaaatcagcggaaagctccagtctcttgtatgagaagttcagattgaatccgaaatagaagcgtggaacagatgaaccgaacattttcacaatgtctttctcgtcgatgcggttgtcaccgttctgatctttgtatttcacgtcaccgggagctacgtccgagaaggtttgttgcggactgttgttgatttcctgctggctgttgaagaagccgatagcttccaggccgtacatctgtccgatacggttgcccttggtatacaggtagtcgtattcctgatatgcctggtttacattgactacctctgtattcagatatgacatgctagcaccaataccataatggaaatcaccgatcttatcattccaactcaaagaagcatccactcctttgtatttatagattccttcgttcacctgacctactgtgataccgataataccggaagtagaattggcacctgacacaagtatatccgaacgtttttcgtagaaaccttctactgttgcattcaaacgattatcaaaagcagcgagatcaaatccgaaagtcgctttctgtgatttttccgctaccaggccgataaccggcagatcgccttcactgccaccggactgtcctccggcattcactccgaagttataaccggcaccgccgctgccataagactgacgccatagttcgtggctcagattgccgtcccatccggacagaccgtaagaggcgcgaatcttaaagagattgatcggtgtcaccttttccataaatgcttcgttggaaacgatccatgcagcggaaacggcaggatagttcgagtatttgtctccgtcgggcaggtaagctgatcccgaacggttaaatacggcattgaggctgtaacggttgtcgtaagtatatgtggcgttcaccagcacagactgattcttctgagagttgtttctgccgtttttgacaacagactgcatatcataaatcaatgctcctcccacctgatgtttgccaaaagtgcggttataatccacctttgcctggaaatcgctgcgtagcatcagcctttcgaaaggctgtgtatgtcccagtgtttcggagtctgtaccataaatggcaggagttgtcaccagtgtaccatcgctggtgatacttgcattgctgttcatgtaacgatactctttattggtggtttcattcattcctccgatattatcgaaagagacggatgcttcggctgccagccctttggtcaacgcacttaaatcctgacggatgcttaggtcggcgagtagtgttccgtatacgttacggatgtgtccgtagtctttcaacagagctaccggattaccggttccgtacacagaactacctccataaatgccattctcataacgaatggggaatgcagcggatggaatgccatagattttgttgaaaatagcgctgcgtccatagcgggtacctctgaattctttcagtctgcctacaatgccggctttcagcaatgtgctttccgtcacttttacgtccagattggtacgtacggtcagacgtgtgtctgtaggtgtagtgtcgaaacgtgtatcttccgtgtttttcttcaacatggagcgatcccggtaatagtcaactaccgtgtaaaaacggaatttgtcactacctccgctgaaagacattttcaggttgtgggtcaatcctgtgttgttcagcgtttcattccaccagtctacattcggataatcatacggatagattcctgtccggaaagcatccagttcctgcgcattgtagcgtgcaggcagaccgtctccgcttaatgcggtgttaagagcgttcgcatacgtataggcatctgcgaagtccggagaacggaattgggtattgacaccgaaattatagtccacatttaccttcagaccattgcttattccgcgtttagtcgtgatcagtactactccattcgcaccacgcataccgtagagagcagcggctgccgcatctttcagaacgtagcatgattcgatttccatcgaagtgatgtcactgatatcacgtgggaaaccatcaattaatactagcggggcatttccgtgtatagagagggtggatacgttatcggctgacgagcctgtaccctgatatacattcagacctgccacttttccatacaaagctttgctgatatctatgtacggggatttttcgaatgcggaagcattgactccgttgatagagtaactgctggtccgggaagatacgttcatctggtagccgatgctcagtgtatctgccagctgcatttccgaagcagctttcgatgtctgtgcattcagggataccgaacctcccaggagcagagtgattaatatataatttattttattcattgttcaaacgatattagttaacgtgtcatttaccagcccgggttttgggtcattccatattgcttgttgatttcctcctgaggaatcggagccagataccacttggtatcccagttggtagcccagtaatggtctcccagttcgatcttctcgaaggtgaactcagtcggattgttcaggtcgttacctctgcttctgagtccgtacaacttcttcttgaagtcgctctgacggtctctgcgaacgaggtcgaaccagcgtacttcttcaaatcctaattcgagtgctctttctctcagtactgcttcgaggaactgatcgtgattcatcgtcttggaaagttccggcagacctactctctttcgtacatcgtttaccattttgtaagcctcgtcggtagggcgtccgttgacttcgttgagtacttccgcatatcccagcatgatttccgccagacgggtgtgtgaccattgtaccggaccttcgcgatcgttgttttcctgtaagatgtacttcatgatcaggaatccgctaccgtctttgtagtcggcatggttgatataaacaggagctgttgttccgttgcagtaggtgtctccgggacaagctacattttcatacagacgtgggtcgcgggtgggcaccatttcgccttttgtaaagaacggttgcttggagggtgacttccagtcgaaatttgccggaaaatcagttccgtcttcccacggaaacatatctacatagttcaatgtagggccgctgtaataacgttggccgataaagctgctgtgaacatcggagccatatccttgacgggtagagattaatatttctgttccgccgcggttgtagtaggcctgacgataggccagacgtcttgcccggtgcgtctcttccgtaggttgaatcagttcgtattcgtgccgtttttgtaattctgtgaaaaaggctgcgcctgcttcggcggcatctttccatcgttggtcgctgtaatttccgtaacaggtatattcgtctgcttccggatgccatttagtgtttgagttgaaagtcggactggctgcccattgcaataccttgaactttaatgccatcgctcctgccagggtcatacgtccgtcatctgctttctcggctttccaggccagattggagttgatggcttcgttgagcaatcctacgatcttctctaccgtttcggcaaaagtgatacgggggaaattcattgtctcgtttacgtctacatagtggtccagccatgtcacaccgcctacatatctcagcatttcgaaatagcagagggagatcaaaactttggcttccgcgatccgctcgcttttctcgctggctgtcatgtcgggcactttttctacgttctcaatgtacaaccaggcataacggattgtagtccagtcggatttgcttccataacggtaagcggaatttttgggaacattgttggcgctgagtgctccgttgtaatagagcttgacaggaccgtcactgatattatcacggaaactataacataagtctgtgattgattcaagtatgttcacacccaatttgtagtcagagccggtcggtagcccataaggtaatccggtatatgctttggtcagcaccttttcggcatttattttcgaagagaacatttcttcggtagtcgctccggaactctcaggctggtcgcccagaaatttatccccgaagctgatttcagaacaggaggaggctatcagtacgcaacccaatgctattccgagtccttttattattctattcatacagtcgttttttagaagttaagatttaaaccgaagctatatactttgatcagcggataatctccgaatcggttaggatcactttccggatcaagatatttaagcggtgagaaggtcagcaggttgtagccgctgaagtttaatccgagtgagctgaggcccagtttcttcaggaatttctttccggtgatggtataaccgaagctcaggctcttcaagcggagataggaagcatccaccaaccagagggtagagggttcggagttccagctttccgattcttccgacggacgcggataagtagctcccagttggttttccggagtccagcaaccgtcgtagaagtaggtcagcaaaccacgctttccggcattcgtataagggatacggtattcgatgtcatacattctgttaacgttcttggaacccacccattgcatggtgaagttgaatcctttccagtcgaatcccatgttcataccgaaaacgtattccggacgggtagcataacctgctacgctcttgtcattaccgtccacgatgtggtctccgttgaggtcggcgtacatggcgtcacccggatataccttctgataaggctgaggcagttccggctttaaggtcagttcgccgtcggctccggtgatgaagtcgctgtactgatagagacggatgtagttgtatactccggtctggcgtccggtagagccaccggtctggttcatataagagaattgcttgggcacttcgtccatatagaggattttgttgcgtgcgaaagagacgttggcatccacattataggtgaaatcctttccgatcttatcgcgccagccgagagaaacttcgtaaccgtggttgtctaccttaccaatgttcaggttaggcagtgcagttgcgatgatgcttggggtcgattccggagagatcagaatacctgtgcggtgttcgataaagtagtcgaaggtagcggacaggcggctgttgaagaacttaagatcaataccgtagttctgcttgtcggctgtttcccaggttactgccgggttacccatacgtgagatggctgctgccgattgggaaatcggattgtccacaccgaagctgtaactgcccgatgatccccatacggcaggcatgtacataaagcgtgagtctactcccttgtcgttacctacacgtccccaggatgctctgagttttaggtagtctacgattttctggttttccataaacttctcggcagttgcgatccatccggcagagaaggaagggaatacaccgaaacgtgtgctgcccggagcaaagttctccgaaccgttgtagccgacgtttacgtcgagcagatatttactttgataggcgtaagtagcacgtcctaccaatcctacgtagttacggggcagataagtgtagctgtccggataatagttacgcgactgattgtaaaggaacagaccggatattctgtggtcgccgaatgtacggtcatagttgatacgtccttccagataccagttctgtccgcgtccgctgctttccgagtaagtgagcggagtatcgctgccgctgggtacatagataagtgatttatcgtagtcgggatcggtctgtgacatcgtaccgttggtgtcaaagtatgatttgtagtacacagtctgcgcttcgatggcgcctcccgtacgtactttttccagtttgaatttattgtcgtaagcacctttcacggaaacgctcagtcccggagtgataaagtccagtttctgtgtgatgtccaaatccagattcaatgtcgtgtcatacgtttgattgtaaccttgtccgtagaatacgaacataccgtcacgcatcacttctcccagcggaaccatatctttaggaatcagtgtacgtactccgttgataaatcccggtccggcaaacggatgtgaccagatctgtgcgattacccaaggattctggtcttcacctgtgcccgaaacgacgctgcgcggttcctgtatcttgcctaaaacaccaccgacaccgagtttcatcgaagtggtcttggtcagattggcatcgatattggcgcggtagttatagcggttgtaacgatagttattgtcgtacatttgtccgggaagttctttcagaagtccgttctgataagtataacctactgagatgaagtatcgtacattatcgctaccgccggagatatttaggttgttctggctttgaagatagatattattaaaaatatacttcttccagtccatactgggatacatgatggggtctgagccggtgcgataggcttctacctgttccggagtgaagtataacttaggattcgtaacgtggtccatctcctgcttcatattccagaagcgtgcaaactcgtaacttccggtctgctctaccagtgagatgggttgttgcagacccagtttggtgctggcggaaatctgcgttttgcctgctttacctcttcgggtggtgatcaatacaacgccattagcacctcttactccgaatacagcggtggaagaggcgtctttcaatactgaaatactttcgatttcgttcgggtcgatttgtgaaaactcacgttctattccgtctactaaaaccaagggcttggattgtgaatcatttaatgaaccgacgccacgtacgtagatggcagcagcatctttaccaggctgtccggtagtctgtacggaagatacacccggcaatgctcctgcgaggaggttcgtgatacttgttgccggagatttgatcaactctttgttgtcaatggaggagacggcactggtaagcatgcgcttgtcctgattaccgtaggcgatagctacaacttccacttcaccgaggttctgtgcatcttcttttaaggaaacattgatgattgtcctgtctccgaccacgatctcctgggttacatacccgataaaggaaatgttcaatacggattttttgcttggggcaacgatcgtaaagttaccgtcaaagtctgtgattgtcccaatgctcgtgcctttcacagtcacattagctccgggaacgccttctttgagtgtttcatccgttactctacccttaattgtgataccttccgggggcaaggcatacatcaacggtatgaataaaagaaacgtaacaagaaagcagaatcttaaattgagcgcgtttctcatactgtttaatttgataggttaataatatatttagtttatagttaggtcaaccgggttggggtgacttttattctctttattttctcttcagtttctaaatatatccttgtgcttatgtgcaataaggttaacttcatttatcttttaatgatgatgcaaaattaggggcgatgtgaaaaatgaacgtgcaatattcaccaaattaggtgcacaaatagctagaaacactatctgtaacaaatgggtagaccttgatacaaaattatagacgggatggaaaaggaggctttgtaaggaacaatgaaaaagcccatcctgttatattgcacataggcaataacaggatgggcatctgattggtgcttctctctggagaatatgtcttgtctagaagctgaagcttaatcctcccaggaagttaagaccttctgtaggatagcccagataatactggtatttcttattgaggatattattaatccgggcatacacggatactcctttgaacacattatagctggctccggcatgcaggtcgctgacagctgcggctttaatgccttctacctttgtgcgtccgatataatcgtaaccgagattgatattcagtcctgtgatcgggcggaagtctgcgctgaaattaatctcgcaggcaggcttcatatacaggctgtatttttctttcgcatcccagttacggtaagttccagcagcggacaatgcaatgaggtctttatattcatagctgatcttcataccggcgtagaagttgttggcattgctgaattccagattcagatattgatgtgctgtgaccggagacggagtgttctctccctgaccatcaccatggggaagtgagggattgttgttgtaatccatttcctcctgcacctcaaagaaatcgtctttcaaatcctgataaccgccatacagattgatccataatccgggataaggactcgctttaaatcctatcgccgcattcagctgttcgtatgtatcaagaatagggcctgccggcaaggcataaggacagattgtttccagtctgcggaaatcgttgaccagcttgcctccggtagcttgtgcataaagtacgtagctgtcggagaagatatactgtgctgttacatccggagaaacgcggaatgatttaccgctgccgaatgagagatccacattggctcctgcacgcaggttccagctgtcgctgctgagtttataatacggattcagtgccagagcggtacggttctcgtatacctggaggtcgtcagcaagcttcaggtctttgttgtagatgagattacgcatgtccagtccgatgttgatgctctgttcgtcgctgatagcgccgctgatcaatcctttggtatgcacttgtgtttctccgactttgtcattgaaaaagaaagtgttattgttctgacggttgtacatcatcagattggtttccgcttcgaactgtatgggataattttcatctgtcgattttactcccagatggaagtctcctgaagtaaacttctgcttgccgggctgaaccggagaaaggttgaaattgctgagtccgaaattagcggcgatgttgaaatccaccttattgaactggtggatataatcgatattcgcacgggtacggtaataataagcattccatttcgtgtctgtttccggcatagtcagtttgccatccatcccatccatctgaaagcggacgttcagcttgtccctgtccgacagacggaacaggtaattggcaaggagatccagattaccgtagtttccatatccggcgcgtatatatccgggcttgctgccgggctgcacttccgttcctacatagggacgcatcaggtcggcaggaatggaggtagccgggaagaaagtagtggcatattccacttcctttttgctgacggtaggttcttccactttgggtagcacattcactttggaagcatccagaatgtccggattatattcctgttctacgacgaccgtgcggttcatggtcgtatctttcgactgagtattctgtgcctgaaggttgaacggcatcagaaatgccagtgtaaagcctcctgctatataaagagttcgtttcatacttttcatctttacttgtttagtttctttagtctgtcttcaatcatgctctcgatatcgtcattgccctggtagttctgttgcaggctcagcagatactggcgtgcgtcgaggtctttacccatagcgacatatacgtccgacaggaggacaaagctgcgtgccagccaataagcgtgtggcgtactctgttcgatgtagttgagcagctctttttctgccgccgcatattcttgggcatcgtaaagtgcttgggcaacctggtatttagcttcggcaccataagaattacgggtatccttggccagttcgcggaaatcatccaatgctttcttgtccgctttctgattcttataagcttttgcgcgataataaagagcttcgttttttagttccggactaagcttggcttcagccagcacctcggttgctgcatgaattgtttccacatcgtctctcagcaggaaggcacagcgcaggatgccggtttcggcaagctggcggcgttctacattggtcgctttttctttcagcatcttgtagcttgccagagcttccgccatctgttgttggttgaactgtacttccgcacgcatgatcagcgcttcttctgcaaatggattattcggatattcaagcaattttccggagtggaggagcaccatatcataattcttctgctcatttccaatctggcagagataataatgtgcattcaggctaaatgctccttccgggaaggtttgcagatatttattaaggctgctcttggcttcttctgttctgccacgtgcataaatcttttcggcagccgcataagtaagcgaatcctgttcgctggcgtcaaagcggatgtgtcccggcatcgcattggctaaagccgcaaattcatcgatacggttcaagtctacatagatagatttcatatcgcgcattgccaggcgggcttcttcgctgcccggatatttctcaatcacttgtttgtacgcattgattgcctggtcgaaattgccgttctgataatacagcaaaccgatttcagccgcagctttccggctgacggggctttcgggatatttctccagcaattccttgaaagaagtaatagcctgaccgttgttatccatcagtacataagaacgtcctttctcgtaaatagcattcactgcgtatggagaagaaggatatttgccgaccagtctgttcagaagagtgattttgccggtatagtctttctgtaaaccggataccagtgccagctgatagaaggagtaatcgccggaaggagtattcatttgttcggcttgcgagtagtagtgcttggcttcttcaaagttgcgtacattcagatgacagtctccgatacggttgtaggcatctgcaagcgctgttctgttttcgcctttttccagttggatatacttttggaagtaattgcttgcctgtgtatagtccttgcggtggaaagcaatgtatcctaggttgtagttggcgagcgcatacatttcattattgggctgcgtggtcagttgcagataagcgttgaaatcgcgggcggcttccatcatccggttgaggcggtagtaagattctccgcaccagtaataagcgtccgcctttgtctggcggttgtactgcccgatggcgatggactggttcagatattggagagcctgttcgaaattggcattggcaaatgactgtgtacccagttggaagagaatcttttgtttggcttccatgatctgtgcactcggcttggcgatccgttcgattgactttaaagcagcttcgtagctgcgggtattcatataaacttctaccagatagttgcttactttctcggcatacggagaagtcgggaattcattgaggaatttttcaaaagcagtaaccgattcaccgaaagcggagtaggacgtttcgtgcaggcaaagtgcgtagttgtaagcggcctgttccttaatctgcaggttggcgttggaggcggctgcctgttcgaaagccatacgtgccttgttcttttctgccagttgcaggtaagagagtcccatgtgcaggtaagcattctgggtcagtgcgtcgttggcggtcgtcacttgtcccagcatttcggctgctttggagtagacttttgtctggtaataggagagtcccagcatataaagtgcatcccggcggggagcggaatgatctctgtccagatagccggtgaatgcttccactgcctggtgatattgtccgaaatggtagtaagcgtctcccagaatgcggtacatctcggcagcgtgctcgttgtttggataggccgacaggtagttttgtgctacaatctgcgccttatcatagttctttttgatagcatagatttctgctatgtagtaaggtacgagttctttgtacttcgggtcgtcctgcaaaggaaggaagtctttcaacgcttcatcataacgcttctgagtgtagcggatataagcgagatagtaactacagtcctttgcatatttggggctgctggcacgtaacgtttcgaaccagatggcggcttctttcagattatcagtcttcatgtagcaggttgccagttggtaggtgcggtcgtcgcgctcttcatttcccagcagatcgagccgtgtagaattgaagagtgccagggcctcatcatatttcccttcgtagaagtagcaggaagccagcagcgaatagattcggttggcgtagggagtatccggataacggtcgaggtacttgcgcagtaactcgatgcggtttttgtctttcagttcataagctgaactgactaacatatattctgcgtcctgaaggagacttgctgttggcttttgctttacaaatgctttcaatgcaggtatggcggctgcataatttttttcctggaaaagctctttcccttctttataaaggttgacaggagaggttatcttttcgcttgtctgtgcggagatggcaattggtgcacaacacaacaaggtgcagataattcgtgatattcttttcttcataatctagtgttttgacaaaaatacgactatatcttccaacgaaaaccctttgaaagttattttataatcatttaaatctttatgtaaattatctctcatccattttgaatccgaaatacttattcttttgggactctttttcatcttcctgatgagagtaattaagtctgatgttgaatttcatgtgattgttggtttataattaatggcggttacaaagataatacgaatcttagtattttcctcatttaaaacgttttctgatacccaaaagtttagtgccccctttagttaactgtgttgagccagaaactgtacaagtccccgccgaatggaatccagcccgaaatcttccggatgtatatccgataatggcaaaaagaaagaatctgccacgtcatccattgccgagaaatggctcatgtcttttacggtacagagaaagaacatatcgagcgtatgaacgggaaagccggaatagatataaatgttcggcagggagaactgataggtcgctttttctaccttcaatcctgtttcctcccatacttccctgcttaccccttcttctcccgtttcgttcatgtcgataaatcctccgggaaggtcgagtgtccctttggccggttctttggcacggcggcagaccagcagttccttcttttcattcagaatcagtgccacggttgcggaagacggattgaaataataaacaaagccgcagtctgtgcatttcttagacttctcgttgtttacttcgaagtgcggagaaccgcattcggggcagtacaggaattgggcaagaggatggttcatcataactgattttatataatagattgtttgccgacaaaaatataaaatcttttcttcagatatggaataatgtgattacaaaatgctaaataccccgtcttattagtatcattaataacaatcatatacaaattaaaagaatcagactatgaataacaaaatgaatattcctttatcaggaattattcctccgttggtaactcccttgctggacgatgatgtgctggatgtggaaggtttgcaaagattgatcgaacatctgatagcagggggagtacatgctctttttgtgttgggaactactggcgagtcacagagcctcagctataaattgagggtagaaatgattaagaatacctgccgtatagcgaaaggacggttgccggtattggtatgtatttccgatacttcgattgtggagagtgtgaaccttgcctgccttgcggcagatcatggagccgatgccgtcgtttctgctcctccttactactttgcgacaggtcagcccgaactgatcgagttttatgagcatctgctgcctcagttgccgttaccattattcttgtataatatgccgactcatacaaaggtaagctttgcaccggctacgattcagcggatagcggagaatcccggcgtaatcggttttaaagacagttcggcaaatacggtttatttccagtcggtgatgtatgccatgaaagataatccggatttctcgatgctggtgggaccggaagaaattatggcggaatccgtactgctgggggctcatggcggcgtaaacggtggtgcgaatatgttccccgaattgtatgtgagcttatacaacgccgcgaagaatgcagatatggaagaagtgagacgtttgcaggaaaaagtaatgcaaatcagtgctacgatatatacggtagggcaacatgggtccagttacctgaaaggtctgaaatgtgctctcagtctactcggaatatgcagcgattatgtggctgcgcctttccataagttcgaacaacgggaaagaggaaaaatatggaaagcgcttcaaaatctgggagttgatgtagtgctcaggtaattaatcaagaaaaaatgaacggctatgtctattctcgacattattatctttttattcttcacggggggagttgttgtcttcggctgctctttcttcaacaagaaacgttcgtcggaggaatttacttcggcaggacgttcccttccgggttgggttgtgggaatgtctattttcgcaacgtatgtaagtagtatcagttatctggcttatccgggcaaggcctatatgtccgattggaatgcttttgtattcagcttgtccattccgatagcctcgtattttgctgctaaatactttgtacccttttatcgttctatcggaagcgtatcggcttacagctttctcgaagaacgctttggaccctgggcgcgtgtgtatgcgtcatcgtgttatcttttgacgcaggttgcccggatgggttctattctgtatctgctcgcattgcctatgaatgccctgctgggatgggatatcaagatgattatcgcagtaaccagcgttgccattattgcctattcaatgttgggtggtctgaaagctgtgatatggacggaggcgattcagggatttattctgattggtggtgcgatagcctgcctttgtgtgctgatgtttaaaatgcccgaagggcctgcgcaggtatttcagatagccattactgaccagaaattcagtttgggaagtttcggcagcagtctgaccgagtctactttctgggtatgccttatttacggtatatttatcaatctacagaattatggtattgatcagaactacgtacagcgttatttgacggcaaagagtgataaacaggctaagttctccgctctcttcggaggttatttgtttattccggtttctgcagtgttctttatgataggtacggcattgtatgcatattacaagacgtttccggaactgcttccggcaggggtcgagggggacgcggtctttccctattttattgtacatgcgcttccgaccggacttaccggattattgattgcctccattttcgcggcgggaatgagtacggtggctacaagcattacaagttcggctactatcattctgacggactattatgcccgttatataaataagagaccgacagaaaaacaatcggtgagagccttgtatgtttcgaatgtactgatcggaataatcggtattttcgtagcgctggcatttctgaacgtagagagtgcgctggatgcctggtgggctttgtcctccatcttcagcggtggtatgctgggactcttcctgctggggtatatttcaaagaaggcgcggaatgttgacgccgttttgggagtgatctgtggcattatcgttgtcgtctggatgagcttgtctcctatcttctttaaagatggttttatgagcgaatatgcaagcccgtttcatgctaacctgactattgtcttcggaaccattgttatctttttggcaggctttctcagtatgcgtttactgaaaacaaagaagtagaagaaggcagcttcactggcaggcatattggtttcatctattatccgatagaattattcgattggactttttttgcaaaggcggggtttccgcctttatctttgcatcagaaacaaaaaacaaaacgatgtttctgatgttataagtcaaatcaattaataacaataaaagcaataaagagtatggaaccaattttaaattctcaacttcctgaattcagtgttcaggcttttcaaaacggagctttcaagacagtaaccaacaacgacctgaaaggtaaatgggcaatccttttcttctaccctgccgactttacatttgtatgtccgacagaattggtagacatggctgacaaatatgctcagttccaggaaatgggtgtggaaatctactcggtaagtactgactcgcatttcgtacacaaagcctggcatgatgcttccgaaagtatccgtaagatcaaatacccgatgctggcagacccgacaggcgctttgagccgtgcactgggtgtatatatcgaagaagaaggtatggcttaccgcggaacattcgtcgtaaacccggaaggaaagattaaagtggtggaactgaatgataacaatattggtcgtgacgccagcgaattacttcgcaaagtagaagccgcacagtttgtggctactcacgacggagaagtttgcccggctaaatggaagaagggcgaatctactctgaagccaagcattgaccttgtcggtaagatttgatagatcttgataatgtgtgtgaagggccggtaacggagacgctgccggcccttcttttaaaagaatgaaaggagaaagagagatgttagaacctgcattaaaagaacaactgaagggtatttttgccggactggaggctgactttacctttgatatatccgtatcagccagtcatgaaagccgtgccgaattgctggaattgctgagcgatgtagccgaatgttccgatcacatcacttgtatggtaaatgaaggaagcggacttaaatttacgataggaaagaatggtaaacctacagaaattactttccgtgctatccccaacggacatgagtttacttctttattactcgccatcctgaatctggacggtaagggaaagaattttccggatgaggctgtctgcaaccgtgtgaaagccttgaagggtccgatacacttagtgacctatgtctcactgacttgcaccaactgtccggatgtagttcaggcattgaatgcaatgaccacactgaatccttccattactcatgaaatggttgacggtgcactgtatcaggatgaagtggatgccttgaagatacaaggcgtgccttctgtatttgccgatgggaaactgcttcatgtaggtcgtggcgaatttggcgaattgcttgctaaactggaagcgcaatacggtattgatgaaaccaaggtggagacggaagtgaaggaatacgatgttatcgtagccggtggcggtcctgccggagtatcagcagccatctattctgcccgtaaaggcttgcgcgtggcgattgttgccgagcgtgtcggcggacaggtgaaagagacggtaggcattgagaatctgatttcggttcccgaaacaacaggaagcgaacttgccgataatctgaaaacgcatcttctgcgttatcctgttgatttgttggaacagcgtaagatagaaaaggtagaacttgccggaaaagataaactggtaactacttccgtaggagagaaattcattgctcctgcattgattatcgctacaggtgcaagctggcgaaaactgaatgttcccggcgagaacgattatatcgggcgtggagtcgctttctgtcctcattgcgacggtcctttctataaaggaaagcaggttgcggtagtgggcggtggaaactccggcatcgaggcagccattgacttggcaggtatctgttctaaagtcaccgtctttgaatttatggatgaactgaaagcggataatgttcttcaggaaagacttaaatctctgccgaatgtggaagtattcgtgagttcgcaaacgacagaagtaattggtaatggcgataaactgacagccttgcgcatcaaagaccgtaagacggaagaagaacgtttggtagaactggacggagtattcgtgcagatcggactttccgccaatagcagcgttttccgtgatattgtggaaacaaaccgaccgggtgaaatcgttatcgatgcgcattgccgtaccaatgtgacgggaatctatgcagccggagacgtatcgaccgtaccttacaaacagattattatttctatgggcgaaggtgccaaagccgccctttctgcctttgatgaccgcgtgcgggggctgattgtataagtaatggccacagagattgtaaaaagtctcttgtggcttttatttttttcttacctttgtgattctaatatttaacccccaatgagaaacatgaaaaagatattcttactgatttccgcgatcttgttaattgttccggtgcaggctcagcatacgttgagactgatgacctataacatcaaaaatgcaacaggcatggatggtgtctgtgacttccagcgtattgcaaatgtgattaataacgcttctcctgatgtggtagccgtgcaggaagtagatagcgtgaccaatcggagtaatcagaaatatgtattaggtgagatagccgagcggacgcagatgtatgcctgctttgctccggctatagattatgatggcggaaaatacggaatcggtctgctgtcaaagaaagctccggttcatttgcagactatagctctgcccggcagggaagaagcccgtgcattgatcttagcggagtttgaagattatatttactgttgcactcatttatcccttacggaagaagaccggatgaagtcattggagattctgaaaacttttgcagcttcctataaaaagcctctttttctggcgggagacatgaatgcggagccggaatcggactttattaaagagttgcagaaagaatttcggatactctctaatcccagacaacacacttttcctgctcccgccccaaaggagactatcgattacgtggcggcttttaagcagaatgataaaggatttgccgtcgtctcttcggaagtggtgaatgaacctgtagcatccgatcatcgccctattgttgtggaactgcgcactgccgaaaaggcggataagatattccgtactaaaccctatttgcagaatccggttggaaatggaatgaccgtgatgtgggaaaccactgttcctgcttattgttgggtagaatacggtacggatacgactcaattaaagcgtgcgcgtactattgttgacggacaggtagtctgcaataacaagttacataaaatacggctggatgatttgcagcccggtcaaaagtattattatcgtgtctgttcacaagaaatgttgctttatcaggcatataagaaagttttcggaaatactgcccgttctgctttcagtgaatttactctgcctgtaaccggtacggattcttttactgctgttgtgttcaatgatctgcatcagcatacccataccttccgggctttgtgcaggcaaattcaggatattgactatgattttgttgttttcaacggtgactgtgtagacgacccggcaagtcatgatcaggcaactgcctttatcagtgaactgaccgaaggagtgcgcggtgattgtatcccgactttctttatgcgggggaatcacgaaatccggaacgcttattctatcggtttgcgtgaccatttcgattatgtaggtgacaagacttatggctctttcaactggggagatacccgtattgtcatgctggactgtggagaagacaaaacagacgatcattgggtctattatgatttgaatgatttcacccagttacgtaacgaacaggtcggttttctgaagaaagaactggctgccaaagaatttaagaaagcgaaaaaacgtatcctcctgcatcatatccctctttatggtaatgatggaaagaatctttgtactgaactatggactaagctgctggaaaaagctccttttgatatctgtctgaatgctcatactcataagtatgcttatcacccgaaaggtgaattggggaatcattttccggttgttataggtggaggatataagatggagggtgctaccgtgatgattcttgagaagaggaaagaagaactcagagtcagggtgttggatgcaaagggagaaactttgctggatataacggtctgaataatgtatatgatagtttgaatcatagaattgaatttcaccccaaaagtttagtttctaacttttggggtgattctttttatattgataatacctaatagttcctttacctcttttttattttagcttcctcctgagatgacaatgaatgtcaggcccaaaatgaataatataaacatgactcccaaaagtctgtttgtcgctttggagctaccggtaaattctttccagatgaaaacaccccaaagggcagcaatcatcggtgctccttgtccaagtgcataagaaatggctgctcccgcttttcctgcggcaatgtagcttaatgccgtacctaatccccagatgcatcctccgagaattccgaccatgtgtgtacttgcttttccggcaaagtattccttgtaagtgacgggtagaccaacgaacggacgcttcatcacaagtgtattgaagaggaagttgcttaggaagattccgatagcaaagatgaagaatgcagtataaggagttgccattccggttgtcggtgattcaaagttgttcaaatccatggcagcggcgacaaaccggtaaaagaatgacatcagtataccggcaatagcagcaagaataattccctttttgctgttattggttcccgccttttgattcttaccggctgcaataccgttgcaaatgatggcgataacaatcagcacgactcctgtgaatagccagaacggatctcctttgggggagctgaaataattaatgaatactcccaataccaatgccagtcctactcccaatggaaaagctactgccattccggcaatggatactgaggcggaaaggagaatattggaagcattgaaaatagctcctccgataagtgcactggcaatatatgccgcttccacttgttggatgtcttccagaaaacctcttcccgaatctccgaaacttcctagtgtgaataccagaagtagggcgaacagcaagatgccgatggtgtagtcccaataataaagttcataacgccaattcttactggccagtttttgggtatttccccacgatccccagcatatcattgtgataaagcagaagataatagctaaggtgtaactattgactatatacataatgattttttttaagatttcaattctcttttcctgtcacttgtcttataagtgcgttgcgggttgcccgaatattttcttccccttgaatagtgagatattggtgtttaccgctttcagaaggagaaaaaatactttgtccgatactgtctatggtgattgttcccttctcggataaattgaaataattattccccggttctatggcttgtagcacggatgtcaaatcccatgtttctctgtcatatggcatttcctgatatattttatatgatacgcacagaggatgtttataactgccggcaaaatcatttaatatactttgatgaggatatcgaattttgtttcctagttcccatccgctggcaataattggagtaggccattctttgaaagtaatttgggctgcattcagatcattaacaatgttccattcagggaagtcgaattcattaccatagagtcctcccatgacagatagtaattttaccttttgtgctaccaaggcttttccatccagctcgctgtattcatctgcttccgagataagcaaacgggctagatttgtttccgggcctaaggctataaataccacagaatgatcttcttgctctgccagcaatttacgcaacagtttatatccttccagaatatgatcttttaggcttctttttggatgtaatattttattgttgtcaataatagtatccagcgtttggcggagataatgtccgtcgtctgtattcatcccattataagcataacctaaaggtatgtcgtatttgtcgttgaaacgacaataagcgtcaatatattccagtgaataaggattacacttgcttatagtgatacctagcaaatcaatttttccttttttctcataattaagcagcatttgcatggctaaaacatcatcgatatcatttccaacatccgtgtcgagtatgacaggaattgcagaagtagtctctttctgttgtgcacaggaacagaataaagagacggttattagaatgattgctatatatttgaacatatcttgggtttttataagttatttccaatattctcaattgtattgctggttaatgattgttgcgaggaataatttactttataaagtacgcctcctttagcatggagagtctgattttctaaagttgcagttccttctttggtaaatgtgccatttacatcatatcttccggaaatggtttctccaaatttaccattctctagtttgaattgagagtcattcaaactataaatcagtaaataattgtgcatatctaatacgaaacctaaagaagcattatttgtctggaatgtgatttgtgctccagtagtacatattagttgttctaatttgtcttttggctgattatcgttaatattaaatgctgcaaagttctccggttttactttggcaacatctatataagctgccgccaagccttttatgagactacgagtaggaggtgtaaaatctttttcttgtaaatcccatgtataaattccgtggtcaatttggtccggttcggtggtgttgttgataaagaagttactggtagccaaatcgtaaatatcatagcctcctcctaatgcgaaagatgtcaagataagactcggactgtttgcataactacctttgttctcggcaaccagcgcataatttcctgcaattgatgcgtatgccatgacttcatttttgagatgtttaacattatctttataagcatcaacgccaatgaaatcaatgccttgaagatcgaatacatctttggggcgagcattagtagcctctggaaatggattaataccatcaccgtaaattagattgacacgagttactactctgtaagaactgttttttacagcttttcctacagtatttaatgcatttgtgatcattgtccaggccttctctttgcttagaggggtcccatcccgatattttaaatctttttggtcgattctccagcgcattaacgcatcaggttcattatggatctgagctgatataacggggtgcttgtctccattttgagaatcccagtatcggatgtggttaaataaggcggtgatggctttggtttctctctccagtatccattcatcatcaagaatcatggtgtattgataaccataatagttccaaaaatttccttcatcattccggctgagccttttgttatattcttgaagcacatattgaggtatcaggtaggagaatgaatctcctaccatattcgtactgaaccaaagtaattccattttcaaattatacttgttgacgaactgcaagattgagtttacgatactataatcgtacttgttttctttaggctctaccatattccatgaaattggaatttgtacacaatttagtcccagttcctgagctttcttgaagtagttttccacttcattaatagtcatcttgtcacaattgagaagggcatcaaggcgtatttgtgcaccaagaaacggaaaaggtttaccgtcaacagaaacatatgttttgttgttttcagtcactagtttacttacttctatttgagaaagtattggttcgacgtatgtttcattattattgtcagaacaagctgttgcgaataatgaaaagaaaaccagtgcgtaagttagtattatcattcttttatacataattggtctttgttaaattagtagattattggattattgcggggttcctcctcctgtcataggccagcccggattctgatagataggagaagaatccaaatcacctccggatgaagtaaccagaaaatgttctgctgctatcggatcgagatagtgtgccatattccatttatagccgttgtaaacaatgttattggctgtgatgtgataaggagcaagataagtactgaagctacgtggtgaaacattttctccttctttaagaatggagttgccgttagaatctttataccagtcccagccatacatttcctgccataaattcattcctaggatatggtagggtttggtaatcatctggtccattgaacgccatctatgtaagtccatgctacgtaaaccttccgccatcaactcacatcttcgttcacggcggatattataacgtgtggcatcaataatttctccgccggaatatgccccccaatcagtttctgcttcttttgacatatctgtaagcctgattgttttggtatagtcctcatcaatgccggctctgcgacgaatcgctttccagtacttttctgcataggagtcgagtgaaccatgcaattcataataagcttctatatagttgagataggcttcggctgtacggaatatgatagaaccgacaatactttgagtgttatttgtgtatttcccgtcagggtttaatcctttgcgtaaggcatagcctgtattgtacttttctgtaacagaagaggcggttatattgggtccccattcttctactaccccatgatctcctgcctgagtatgcaaatttttctgtcctggctttttgatgaagatgtctgcacgggtatccctgtttttagtgatatgaatgatattattatctccccaataagatgagttttcatctgcccacatcggggatgcataaataggttctccatttttaagaataaaggcgtcaatcatgcttttagtagtgcctactccattgttgccgacacatccgtattgacaaacttcatttgccactcctaatcctgtgttgtagcgcctccataaaagtacttcattgtatttctccatgtcaatatcgcagaacatactgaaataaggattttcaggttccgaagaagtttgtgggaatactcctgtattggcagttaatatattatatttttctgctatgatttgtgccgctttaatagcttcatcaaagaagaactctgattctttttcaatacttccggatttaaatgagtaattagcattataatctttatttgctcccggccatcccggtccattgggtacaaaagctgttcctttaaaattcttcagccatgagccttcgtaaagtgcgacccttgacttgagaaggatagcgcagtctttgcttagccggttcttacctccggaaggagctatgttttgcatcatttctatagctttgtccagatcagataagataaatctggctacttcatttcggggggctcgtttgctgatttctatcagagcttcacgttcattaggataagttttagtaataataggaaagtcgcctaatgattttaatctttcaaaatacatgaaagctctgaagaaatacatttctccgatatagtgtttgatattggtcgtgtttccgacaatggcattgttttcatacgatggaagcacattttcaaagaaataattgcatcggtaaatatcagcgaaataccatgagcctccttcttgtcctactttccagtatccgggtgcatacattacgttaggttgcataccggccatattatctgtgttattgtcaatttcaaaagttccatatccataggtgccatgagtaggtagcacttgatattgatcagtagcaaaagctgcaatattactttctgttgtcagatattcatttggagaaagttgatcaagaggttcttgatttaggaaatcattgcaacttgtcaaaaagagcactccgctcaataaggttgatatcgtaagtcttttcataatatcctgtttttagaatgtgacatttaatccaaaagagaatgttcgggatagtgggtaaacgtttccgtgtccccaactaccgccttcgattgattcggggtcgaagaagtcaataaggctcgtaatggtgaacaagttttcaccggatgcgaatatcctaaggtgctgcattcccattttttgtacgatgttgtgtggcaagctatatcctatctgcagattcttcagacgtagataagatgcatcttgtaaatatttagtttgtgattgctggtttttatcggtgttgaataagggtcttggatagtaggaattcagattcgttcccaatggactggcttcgtcatttcggaaataatcatcgtgtccttttagtgctgtggaaaaccagggcccttgtctaccgtttgcaccccagaagtagtaactaccctgaaaataatctcttttcaatgttccttgccagaacattctgatatcgaatcctttccaatcggcggctaattccagtcctacattatatcggggcgtggagttacctattctttttaaatcaccgtgatcttgtaaggtgcggcttccggcatcaatttttccgtcttcattcagatctttatacataatgtctccggctttccagtcttgtccgagattactttgtccaccgttgattaatcttccgatgtgttcggccatttcctggtcagattgtgcaatgcctatcgtttcatatccccatatttcacccacgtattttccggcataaaatccatctatcagtccggaaggatttgaataacgagtaatcttggtacgactgtcggcaagtgtaaagcgggcactataattcaatccattatttaaccggtctttccacattagttccagttcccatccgaatgttttaagatttgtattattggaactgggaacggctgttccaaggactacaggcaatttctccgaagggccgaccatatcgtcagttttacgaatgtaataatcaaaagagccggttagccgattgttaaacaggccaaagtcaactccggcattccatgtacggattttctcccaggagagattatagctgacgagtgaaggtgcccaggcaatattggctaatgttccgtcaatgatccatgatcctgttcctgtaccgattgtagaataagtcggatataaagaagatgtattttggttacccaaactaccataagaggctctgaccttaaatgtgttgacaactttgctgacaggcaggaagaatttttctctggctatgttccagcctactgatgcggaagggaaaaatccccaacgactgtcactacgaaatcgtgaggaaccgtcatagcgtagatttacttccagaagatatttttccaggtaatcataattcaatctgccgaagaatccggcggtagcccatctgttgtgtccacctgctacattcggagcaactttttggttatttgaatccattccggtagaagtgttgatagtcggttttcccggataaatgactcctagcttctcagcagctatatctttataattattttgttcggcttgaaacccgaaaagaactttcatattatgtgattttgcaaaggtctttgcataatctgtatagagatttacattaaaataatcgctggcataagtgccttcatgtacttgggaatcgttattccatgtattgcccttagtctttccgtcaacacctgtctgatgaacagttaagtaatcccagtgtgaatattgtgtattgtatcgatagcttaaatctccaatcagtcgccaccctttgataggttctaccgttatattcagttgttggtagagccaagtgtttcgttcttgtttttcacctccgttttgcatttggagcacatggtcgtcatatagaataccatttgggtcatagagaggtttggtaggccaacattggcgtccgatttcggcaaaaaaactttcattaagatgtgtcggctgtacatagtcacttctgataaagcgagtattgaatccgactgatactatttttgataattgtgcgttgatttttgcagatgcagtatatctgtttgagtattcatctccgattctgagctctccatcctgacctaaatagttcgctgataaatagtattgtattttgtctgtcccgccagtaacgctgatattgtgctcgtgtgcaaagacattgtctttgaaaaaatagtcataataatcaatattatcatttccttgtgaatatccgtctgcccataacgaaggattattgggcacggggatggtagaatcggtaatcttgccggccatatagtctttgatgcggtttatcctttcttccgagacccagttgtaaggtccccatccggaattggcagctgcatcattatagtataaggagaacgtgtaagagtctaatgaagaaggcatgttgatagggctacttacacgaaaactgttgttgtagttaacttgcgctttaccggcctttcctttcttggtcgttactaagattactccgaatggcgctctggaaccataaatagaagaagctgccgcatctttcagaactgaaatagattctatatcctgcggattaatggaataaatatctccttccataccatctatcaagactagggcacttcctgtagaaccttctccgatagttccgactccacgtacattgatcgattgtttctgattgagacctcctccctgattgctataaatattcaaaccgggaacctgtccttgtaatgcctggactgcattggatacagggattgcttcgaaggctttcgagtcaatgactccgacagaaccggttaaattaatcttcttttgggtaccataacctacaacgatcacttcatccaataaattgtcgtcaactcccagtgttacgtttatcatttttctatcacctactgtaaactggactgttttaaatccgatgtaactgaattcaatagttgaacttggatccgctttcacttggtagtgtccgttaaagtcagtgacggttccggatactatattcccatcttttacttttatggaaactcccagtagaggttctccattattatcttttactgttccggatacataattctgagcatatgtattcattgaacataaaagtaggtagcccagcaggcagataagcttatgacttgagttataagttatcaggtggacagctttctttaagagagtagagtgtcgattagttttcataatccatgaaatttaaaagttgaatgataaggctaattctttttctaacatgaagtgttttacttcatcgagagtaggaatagacggttgggcaccagaacgtgtaacagcgatagctgccgcggcattcgcaaaactcaatgcatctcggtctatttccctttgggcacaaattacagccaatgcaccacagaacgtgtcacctgctgcaatagtatcaatcgcatttactttgtatccgggaagctgaatgatttctttgtcgtttttcatatatacaccttgacttcctaatgtgatcacagcattgcgtgcacctgcctgtaataagcttagagcgatttcttcaagattatttcctgtatattcaattcctgagatgaaggctgcttccagttcattgacgactagtatatcaatggctttcatcagctcctcatcaatcaggcaggcgggtgcgggattaaacaatacctttttacctttttgtttagccagaagagctattcttttaatcgtttcgtaaggaatctcggcttgcataactatgatatctgcttcgtcaattacctttgaaaaatgaataattgaaccgggtaataaagaatagttagctccgggagctactgctatgcagttttcaccactgtcggcaacaaaaatgagtgcagtccctgtgggctgattaacatcatctatgatataatcagtagtgataccttctttcttaaagtgtttttttagaatttctgcatacatatcatttcccaaagaggtaatgaacgttacagatcccccgagtcttgctgctgctacagcctgattggcgcctttccccccgagggattgcatgaaactggcatctccgactgtttcgccaggcgccgggagatggttgacttgtgcaaccatgtcgatgtttgaacttccaataactactactttcatttgaacagatttatgtgtttaacctaggtcttatctcgtttatagcacaacttctcttttataaggaatcgcactctgtgcaccgattcgcgtgactgctatagctgccgccgcattggcaaatttcacagatttagcgagtgaatgcccttcagacaggcagacgctgaatgctccgcaaaatacatctccggcacctgttgtgtcaatcgtctctacttcctttgcgggaatcatggtatattcatctttctcttttacgtaagccccgtctttacctaaagtaatgacaacattctctatacctttctctccgatagcctgagcggcacgatgagcgctttctatattcatcactttgattccggataacatttccgcttcaatgcggttggggagtatggtgtgcacgttcattaagaatgagttgctcaggctggacgcgggagccggattgaggattacctttttcccatatttgcaagcaatagtagctgcatattccactgtgtctatgggaatctcaagttgcatgagaataatatcagcttccttgattttttcttcggctttattgatatcctcaatagaaagcgaacggcttgctcccggtgctacgataatgctattttcaccgaaagaatctacggagataagtgcaactccggacggacttttctggtcggtaaatatatattccgtattaattttctctgatctgtatatttccaatgcttgcaggccgaacaaatcatatccgattttggatatgaaggtgacttcagctcccagtcgggcggctgcaatcgcctgattagctcctttgccaccgggattcatgtagaaggttccgcctagtatggtttctccgggaacaggtagtctgttggctttcacgaccatatcggtattgcaactaccgatgactacaattttgggtctatgaattgatatagtttccatagtattaaaaattaagactatgcaaatgaaagcaataatcatgcatagttttctacattaataattggtttatataatctcaaaaatgatatcttatattggattttccttgtatagaggagagaatatagaggtaatgtgaagcgaatttatataattacaaagagaaaatggagatttgaaaagagtgtttttatcgtctgaaatacgaatcagacaccttactctttaacattcttttgcgctagcacgtgctctgaggacttcagacagtttttctttccgaattttggattccatccacgccgtaaagtcaaagaggcgtaaaagctgactttcatatttattattatataattcatgaatctcaggagacaacttttcccaaaatgcttctctgtcttttttcaggatgggaatatttcttttattcagaaaccataaaatgatacgttctgttttaaaagtctgctctttgggcgaagatagacttcgggtgatggaacgggattcatactggattagctcatgctcctgcacttcataaaagacgatgaggcggaccagacgaatagttctcattaaaggcagatactttatgttatggtctatgatagcgttgctgatatactttttagcagttttatattcttggttaccaatgtgtacgagtgtggtgtaaagcaataattcactttttcgaatagggcctaaccaggcttctttatcataaagtatttcctggtagtctgccataagttgggtacatttcgaaaaatctcctttatccagatagggaaatagttcgtattggaagagaaggcaagttgcatttactttaaattcgagcgaagtgctgtctgatataagctttcttaatttatcaaggaagtaggggatttcgtcatagttgctcacagaccgcaggctaccgagtactccttcgagtacagataaatagtatataggaggatttgaccagaactgctgattctgctcaaataatgagtctagttctttgtatgaatttaaggcagctctgtaatcgcctgctcccatcaggtaattagcctgaaaaagtttatggtttcgtgttaattcaaaattaccttcggagtctgaagaagcggctatataaagttcgttgaccataaggtcattcatatcctgtttttgctttactgttctgatggagccaatatgagataaacgatatttcaataagttgtgtaatgaagattgctctgtgattttccgaatctttttcaaagcttcattttggatgaagtgtttgtgaaaaagctcctgttctgtcatgttgggaaagttcagacggagcagatattccagttccagcttcaaagctatcgtcagaatttcgttgttctcatagaattgtgcttgttctattgtattggatagtatttcgaaacactcttcaaacagagaacgttcataaagcattcgggctttgcacaaattattcagcagatcgtaatagatatctttctttttacgcagggtgagtaacgtatccgtcagcttttcatataagtattgaatggatacttcaaatgagccattgggcttgcgtctgtaaaattcctcttttacagtatttccattcggttgtttactctttatgataatatcataaatcaccagatagtctttttcctccttgtccttgataacctgtagggagaagtgcttcttttctgatttagataacgagtatatcagggatataacggaatctactcttttcatagggaactctttgcattagtattagattgcaatattcgggaatttttatgtaaaaagcaaatctggcattctgtcactttgtgttttctgtagctctttgttgcgtatatttgtgggaagaggccgggcctgttctgaaaattgcagggaattctcatttcctcagatcagaaaaatatattataatgtgattgaatgtttttctgccttgaaaattgaatgtttgatagtctatctgaaaataatactcattttggatggtttttcataagaaaagctataccttcgatgtactttttaataataaagatgaaatgttggatttaaagcaacttacagttgaagtatgccgcatagctaccgaagctgggcattttctgaaagaagagcggaaaaacttccgtcgtgagcgtgttatggaaaaacatgcgcatgattatgtgtcgtatgtggataaagagtctgaagtacggttggtaaaagcgctttctgccttgttgcccgaagcaggatttattacggaagaaggctctgctacttatcaggacgaaccttactgctgggtcattgatccgttggacggaactacgaattatattcatgatgaggctccttattgtgtatgcatcgctctgcgcagtcgtaccgaattgcttttgggagttgtgtatgaagtctgccggaatgaatgtttctatgcctggaaaggaggaaaggctttcatgaatggtgaggaaattcatgtttcggatgtccgggatatcaagaatgcatttgtgtttactgaattaccttataattatgatcagtataaaccgacggctctccatctgattgataacctttatggagccgtgggaggcattcgcatgaacggttcggctgcggctgcaatctgttatatagctaatggtcgttttgatgcatgggccgaagcgtttatcggtaagtgggattattcggcggctgccctgattgtgttggaagcaggcggtcgcgtgactaatttctatggtgacgaccattttatagaaggtcatcatattattgcaaccaatggatacctgcatcctttatttttgaaactcttagcagaagttcctccgttggatatgtaagactgctgcgattgtataaatagctactactatgaaacacacattacttataaaagattggctttattcttttttgtccctttggtttccccgttgctgcgtcgtttgtggcggatcgttggctaaaggagaagagtgtatttgcaccatgtgcaatataaacttgcctcgtaccgattatcatcttcggaaagacaatccggtagaaaaactcttttggggtaagtttcctctggaacgtgccacttcttttttcttttatcgcaaaggaagtgattttcggcaagttctccaccaactcaaatatggaggacaaaaagaaattggtgctattatgggacgatatatggcatccgaattgcaggcttccgacttctttcatggagttgatgtaatcattcccatccctttgcataagaagaaacagcagatacgtggctacaatcaaagtgaatggatatcgcgcgggattatggccgtaacaggtattccggtggataccgaagcaatcatacgccggaagaatacggaaacgcaaacacaaaagtcagctttagaacgttgggagaatgtagatggaatcttcgaattgcatcgttcggagtatttggcaggaaagcatatattaatagtagatgatgtgttgacgactggagcaactaccgtagcgtgcgcttctcggctggcagagattgaaggagtacggattagtgtgttgacgttggctatggcagaatagggtagcttgtcgtcttcccgaagactctctttaatatataaactataatgaatgccaatgcttacattatgttgttgctgttctacaaataagtactttctcttcataaattaattcgtccgcctatgggcaaacgcaacgttgcctataggcaaactttcgtccggctataggcggacgaaagaatgcctatagccggacgaattaattcatgtacccaaagaacttactttattcagatggaaagtttattgttaacctttgaatctttaaagttttatagaccatcaaaagacaagaatgtttttgtgaataaaagaaggggatgagagtttcggttttcggactgaccctctattttcgaagcaggggggagaagagcagaaacaaaaaagaggtctatctttcgatacacctctttttgctcttcctcttggacttgaaccaaggaccctctgattaacagtcagatgctctaaccgactgagctaaggaagaatgttgcaatcaagaatttcagttttgctcttcctcttggacttgaaccaaggaccctctgattaacagtcagatgctctaaccgactgagctaaggaagaatgtttttctcaattgcgatgcaaaagtagtaggtttttttgaaatatgcaatatctttgcaaaaaaaatattgagaatggacaaaataataggattgggcaacgccctgatagacgtacttgcaaccctgaaagacgatacactcttggatgaactggaattacccaagggaagcatgcaactcatcgatgacgctaagttacagcagattaacacaaaattttcacaaatgaaaacgcatctggcaacaggcggatcggcaggaaatgccatacttggactcgcttgtctgggtgccggaacaggttttatcggaaaagtaggaaatgatcattatggcgatttttttcggaaaaatctgcagaaaaataatattgaagacaatttattgacctccgaacagcttccttcgggagtggcatccacttttatttctcaggatggagagcgtacttttggtacttatctgggagcggccgcttctttgaaagctgaagatctgacattggagatgttcaaaggatatgcatacttatttatagaaggataccttgttcaggatcacgaaatgattcttcatgccatcgaactggctaaagaggctggcctgcaaatctgtctcgacatggcaagttataatatcgtggagaatgatctggaatttttctccttattaataaataagtatgtggatatcgtttttgcaaacgaggaagaagcgaaagcatttaccggcgaagaaccggaggaagctctgagagtgatagccaagaaatgcagcattgctattgtgaaagttggagcaaacggatcttatatccgtaaaggtacggaagaaattaaagtgtcggctattcctgtagaaaaagttctggataccaccggcgcaggcgattatttcgctgccggatttctgtatggtctgacgtgcggatactcgctcgaaaaatgtgcaaaaattggttctattctctcgggaaatgttattcaggtgattggaacaacaatctctccggagcgctgggatgaaattaagttaaatattaacaaggttctggcggaataaccaaggtttgagttacttttacgtctcattttaatgaaagatatatgaaaaaattgctgaataggcggatagctcttgttttggtggctgtaatagctactgtagctttctttagttttaagagtggagacgaccgcaatttccagattgccaagaatctggatacatttaatgcgattgtgaaagaactggatatgttctacgtggataccattgatccgaacaagaccattcgcgaaggaatcgacaatatgcttttctcgctggatccttatacagaatattacccggaggaagatcaaagcgaactggaacagatggtgaaaggaagctttggaggtatcggttctcttattacctataatacgaagctgaaacgttccatgattgccgaaccgttcgagggaactccggcggccaaagcgggactgaaggcgggagatatcctgatggaaatagacggaaaagatctccttggaaagaataattcggaagtcagccagatgttgcgcggacaggcgggtacgagctttaaactgaaagtggagcgtcctaatgagaaaggcggacaaaccccgatggagtttactatcgtacgtgaatctattcagacccctgccatcccatatgctaccgtgatggataataaagtgggatatatcagcctgagcacattctccggcaacccttccaaggatttcaaaaaagcattgctggatctgaagaaacagggagctacttctctggtcatcgacctccgtaataacggtggcggtctgttggatgaagcagtggaaatagccaattatttcctgccccgtggaaaagtaatcgtaaccaccaagggaaagacgaaacaggcaagcaacacatacaagactttgcgtgaaccgctggatctggatattccgattgccgtattggtaaacagtggtacggcttctgcttcagaaatcctgtcgggctcattgcaagaccttgatcgtgccgttattgttggtaaccgtacatttggaaagggacttgtacaggttccccgttctttaccttatggaggaatgatgaaagtgactacttccaaatattatatcccaagcggacgttgtgtgcaggcgatcgactataagcaccggaacgaagatggaagtgtgggaacgattcccgacagtctgactaacgtattctatactgctgccggacgtgaagtacgtgacggaggtggtgtaatgcctgatattactgtcaagcaggaaaaactcccgaatatcttgttctatctcgtacgtgataatctgatttttgactatgcaactcaatactgcttgaagcatcctactgtagctgctcctgaaaagtttgtagtgacggatgctgattacaatgatttcaaggaactggtgaagaaggccgatttcaaatatgaccagcagagtgagaagattctgaaaacactgaaagaggctgctgaatttgaaggctatatgacagatgctgccgaagagttcaaggcactggaaaagaagttgaatcataatcttgaccgtgacctggattatttctctaaggatatcaagagaatgattgctaatgaaattatcaagcgttattatttccagagaggtggtattatcgagcaactgaaggatgatgatgatttgcaggaagcaataaaggtattgaatgatcctgcgaagtataaggaaatgctgagcgcgccgataacgaaagctgaaaagaagtaacgttgattgtcatatataaaatgcggtggacattagtaagatgttcaccgcattttatatatgcatattatattggttagccaatgggagcccggtgtaagtgttttttttataaaaaagaaggatagcttttgccctactaatcagaatgttctatctttgcatcaattacattttaaatgatttacaatatgtctacagaattattctctactctgccttataaagtggcagatattacacttgctgatttcggacgcaaggaaatcgatttggcagaaaaagaaatgcccggcctgatggctctacgcgaaaagtatggagaatccaaaccgttaaaaggtgcccgtatcatgggatcattacatatgaccatccagaccgccgtactgattgaaacactggttgcattgggagctgaagtccgctggtgctcttgtaatatatattcaacgcaggatcatgctgctgctgcgattgctgcttccggtgttgcggtatttgcatggaaaggcgagaatcttgccgactactggtggtgcacattgcaggcattgaacttccccggcggaaaaggtccgaatgtgattgtagacgatggtggtgacgctaccatgatgattcatgtcggttatgatgccgagaatgatgctgccgtattggacaaggaagtgcatgcggaggatgaaatcgaactgaatgccattctgaaaaaagtattggctgaggataagactcgctggcatcgtgtggctgaggaaatgcgcggcgtatcggaagagacaacgaccggtgtacaccgtttgtatcagatgcaggaagaaggcaaattgctgttcccggcatttaatgtgaacgattcggttaccaagtctaagtttgataatctctacggatgtcgtgagtcactggctgacggtatcaagagagcgaccgatgtgatgattgccggtaaggtagtggtggtatgtggttacggtgatgtgggcaagggatgttcgcattcaatgcgctcttatggtgcgcgtgtgcttgtgacggaagtcgatccgatttgtgcgttgcaggctgctatggaaggtttcgaagtcgtaacgatggaagatgcctgcaccgaaggtaatatcttcgtgactactacggggaatatcgatatcattcgcattgaccacatggagaaaatgaaagatcaggcgatcgtatgtaacatcggccactttgataatgaaatccaggtggatgcgttgaaacattattcgggcatcaaatgtgtaaacatcaagccgcaggtagaccgctattatttcccggatggtcacagcattcttttgctggctgacggtcgtctggtgaatttgggatgtgcgacaggccatccgtcattcgtgatgagtaactcatttaccaatcagacgctggcccagatcgagttgttcaacaagaaatacgaagtaaatgtataccgcttgccgaagcacctggatgaagaagtggctcgcctgcatctcgaaaagatcggggtgaaactgacgaagctgactccggaacaggccgcttatatcggtgtatcggtagacggaccttataaggctgaacattatagatactaatttaattgacaattgacagttgacaaatgacaatgaacagctatatggaacgagtgatctgccgggctgttattgttgaccatcaattgtcaattgtcaattgtcaattgtcaattttatgaagaagttccttcccgacttaattgctattttagcttttatcatcctttcttttgcttatttttttccggctgatatcgaaagtcgtattctgtttcagcacgatacggtggctggagtgggagccggtcaagaagctcaggaatatcttgaacgtacaggagaacgtacccgctggacaaactctctttttggtggtatgcctacctatcagatgtctccgagttatgattctaccaaaccgctgaagtggatagaaaacatctatcacttgtatcttccatcttatgtggtgctgaccttcatcatgatgctcgggttttatatccttttgcgggcattcgggttgtctgtctggttatctgctttaggggggattatctgggctttctcctcctatttctttattttgatatcggcagggcatatctggaaatttgtcacattggcttatattccgcctacgattgccggtattgtactggcttatcggaagaaatatctgttgggagggattgtgactgctttgtttatcgcgcttcagattcagtcgaaccatattcagatgagctactacttcatgtttgtcatcctgttttttgtaggagcttactttgaagatgcttataagaagaaggagttgccgcattttttcaaggcaagtgccgttctggcattggctgcgatgataggagtgtgtgcgaacctctccaatctataccatacttatgagtatagtaaggagactatgcgcggaaagagtgaactgaaacaggaaggacctgctgccaatcagaccagcagcggactggaccgtaactatataacgaactggagttatggaattggtgaaacgcttactttgctggttccgaatgtaaagggaggggcatcggttcctttatccaagaatgagactgccatggcaaaggcgaatccgatgtatagtaacatctattcgcagctgacacagtattttggcgatcagcccatgacttccggaccggtctatgtgggagcttttgttttatttctgtttatattggggtgctttattgttaaaggaccgctgaaatgggctttactgggagctactatcttctctattctactttcgtggggaaagaattttatgggacttacggacttttttatcgattatgtaccgatgtataacaagttccgtgccgtatcttctatcctagttatagctgaatttacgatacctttattagcggtctttgccttaaaagaagtgctggctaaaccggaaatattaaagttgaaagaaaatcggacaggagtaattatcactttggtattaacagccggtgtttcactgattctggctgttgccccgggagttttcttctctagttatattccggcacaagagatggcagctctgcagcaaggactgcctgccgagtatttatctccgatcattacgaatctggccgaaatgcgcaaggcaatgctgacttcggatgcatggcgcagtttctttattatagtagtaggatgcttcttattattcctttatcagcagaaaaagttgaaggcttcttttactatgacaggtatcgtgcttctgtgtctgattgatatgtggactgtcaataagcgctatttgaatgatgaacaatttgtatcgaagtcaaaccagacaggagcattcgttaaaactcagacggatgagataattcttcaggatacggctttgaattatagggtgttgaatttcgtaggatttcccggtaatactttcaatgaaaataatacctcatattggcataagagtgtgggtggttatcatgcggccaagttgcgtcgttatcaggaaatgatcgatcatcatataactccggaaatgaaggatgcctatcaggaagttgccggcgcaggcggtgcgatggatagtgtggacgcttccaaattccgtgtgctgaatatgctgaatacgaagtactttattttccctgccggacagcaaggacagacggttcctgttgaaaacccttatgcgtatggtaacgcttggtttgtggataaggtgcagtatgtcaataatgcaaatgaagagattgatgcgctgaatgatattcttccaacggaaacagcagtggttgatgcgaaatttaaagatcagttgaagggtgtgacgaaaggttacaaagactccttatctaccattcgtctgaccagctatgaaccgaatcgcctggtatatgaaacttcttctgctaaagatggagtggctgttttctctgagatttattatccgggctggcaggccaagattgacggacagccggtggacattgcccgtgctgactatatcttgcgtgtgatgaatgttcccgcaggccagcatacgattgagatgtggtttgacccgcagagcttgcatgttacggaaagcatagcttatgcgtcactggctttattgctgatcggggtgatgattctgatttggttcagcaagaagaagttaataactccgaaaaaaaaggaggctgagaactcttaaacttttttctgatcttgtactatattgtactctatataccttaagcggctctcttcatcccgaagagagccgcttatgcattcactaaaaaattatgaaaaacaaacgctgttttgctgttaattgattttatattccaaagttaagtggttctttaaacagaagaaaaggaaatcgacaaagggcgaagatttgtctattaaatatagtgatattataataattaaggtggatatcaggactgaaaaaggaaaatatgaacataaacagtcgatatatggatagtcccattttgtcgcaacccattaaatttgtgcctgaatatagagcgattattatgaaaagactattgttcatttttacctttttttgcctccttgccattcatggaggcgcacagaatattctgactctggagaactgccttcgtatagggattgagaacaatctctctttacagggaaaacgaaaagcgatgcagaaaagtaagtatggcatttcggagaatcgggtgaagctgttgccgcaaatcaatggctttgccaactttaatgataatatcgatccgcctgtctcagtaactgacggttcttcctatggagtaccttataatattacccgaacgttgcaatatagtgccaatgccgggatagaattgcagatgccactttataatcagactctctatacttcgatttccatagcagagattgtggatgagatgagccggctttcgtatgaaaaggcacgggaagatttgatcttgcagatcagtaaaatgtactatctgggacaggttactgcggaacagattgcattgataaaagccaatatcacccgattggaagaactgagagatatcacacaggctttctttgataatggaatggcaatggaagttgacttgaagcgggtgaatatcaatctggaaaatctgaaagtacagtatgacaatgcgcaggcgatgatgacgcagcagcttaatatgctgaagtacatcatggattatccggcagaaaaagaaatcggcctgttgccggtcaatacggatagtatcgctacggttgctttgaccgggttgtcggaaaacctctatgagcttcagttgcttcaatcacaggtgcagctggcagagcggcagaaacgattgataagtaatggctatattccttctctcaatctgacgggaaactggaggtttgccgcttatactgatgaggcttatcattggtttcattccggtccgtccaatcattggttccgttcttatggggtgggactgactttgcgtattcctatttttgatggtttggataagaagtataagatccggaaagcaatgatcgatatcgaaaccatgaaactttcacggttggatacacggaagaatctgcaaacacagtatttgaatgctgtaaatgacttgatgaataaccagcggaactttaaaaaacagaaagacaattatctgcttgccgaagaagtgtatacggttactaccgaccgctatcgggaaggaatcacttcaatgactgaagttctgcaggatgaaatgcggatgagcgaggcacagaacaactacattagtgcacattataattatcgggtgaccaacctgatgttactgaaactaaccggacagatctcatccttgttcaaataacagataactaattgaatcattcatatggaaacaatggacaataatacaatctccagtacgcatcaggagaaagctaagaaaatgagaaaattacgccgctggcagattatagtaagtctgtttggagttgctgtgattgtttggggagtaattgaaattgtttttctctttctgggctataagcagacggaaaccagcaatgatgcgcagatagagcaatatgtgtcacctgtcaatctgcgtgcatcgggctatattaataagatttattttacggaacatcagcaggtacgtaaaggtgataccttgctggtgctggacgaccgcgaatataaaatccgggtgatggaagctgaggctgcattgaaggatgcgcaggcaggcgccactgtgataaatgctaccttgcagactacacaaacgactgcatctgtgtatgatgcgtctatagctgaaatagaaatccggctagcaaaactggagaaagaccgtcagcggtatgaaaatttggtcaaacgaaatgcggcgacacctatccagttggaacagattacaacagagtatgaagctacctttaagaagctggaagcaaccaggcgccagcgggaggcggctctttcgggagtgaatgaagtatctcaccgtcgtgagaatacggaagctgccatccagcgtgctacggctgcgcttgaaatggcacggctgaatctttcgtatacggttgtactggctccttgcgatggcaagttaggcagacgttctctggaagaagggcagttcattacagcagggcaatgcattacatatattctgcccgatacacaaaaatggattattgctaattataaagaaacgcagatagagaatctccgcatcgggcaggaggtggctatcacggtagatgctatcagtaagaaagagtttacaggcaaagtgactgctatttccggagcgacaggttctaaatattcgttggtgccgactgacaattctgccggaaactttgtgaaaatacagcagcgtatccctgtccgtattgattttacggatttatcgaaggaagataatgataagctggcggcgggtatgatggtagtagtaaaagctaaactctgatagccatgccttcgtgtcctagaaattatcctttttacaattgggtgcccaaaccgataggtattattattctgctgttctttttcctgccgattctttcggtgggcggggtatactccgtgaacagtaccgagatgatgagcggcttgggtattatttccgagcatattcagtttgccaattttgtgacttccatcggtatggcggcatttgctcccttcttgtatgaactagtttgtatacgacgggagaaactgatgtgtatcgcaggttttgcactgatgtatgtattcagctatgtatgtgccaaaaccgacagtatctttttgctggcactctgcagcctgctgacagggttcctgcgtatggtactgatgatggtcaatctgtttacgctgatcaaatatgcttttggcatggaggcaacgcgtaatattactcccggcatggaaccgaaagacgcgacgggatggaataaactggatatcgaaaaatgtatcagccagccggtagtttatctgttttttatgatcctggggcaaatgggtacggcgctaacggcttggctggctttcgaatacgaatggaaatatgtatattattttatgatgggtattctgctgctgtccattctgatactgttcattacgatgcctaatcatggttttgccggacgtttccctatcaacttccgcaaattcggcaatgtgaccgcattttgcatatcattgacgtgcatcacttatgtgctggtttatggcaaggtgctggattggtatgatgatccatctatttgctgggcaacggcgatcagtatcctttttgccgggatttttctttatatggatgttacccggcggtcttcctactttattttgggggcgttgaggctgcgtaccattcgtatgggggctttgctttatttattgctgatgattatcaattccagcgcaatgtttgtcaatgtgtatgcaggagtcgggatgcacctggataatttgcagaatgcatcgctggcaaactggtgtatggtcggttattttatcggtgccttgatttccattgtattggggtctaaaggggtgcatctgaaatatctttttgctcttggctttttctttctggcattgtcggcaggattcatgtacttcgaagtgcagacagccggactttacgaacgaatgaagtatcccgtaattattcgtaccatcggaatgatgattttatatgcattgacggcagcatatgccaatcagcggatgcctttcaaatatctttcgacctggatttgcatcatgcttaccgtccgtatggtactgggaccgggtatcggaggggctatttattcaaatgtactgcaggagcgccagcaacattatattacccgttatgcacaaaatgttgatctggtaaaccccgaagcttctgcttcgtataccaataccgtgcagggaatgcaatatcagggaaagagtgaaacggaagcgcataacatggctgccatgtccgtcaaggggcggatacaggtgcaggctacgctctctgctgtgaaagaaatggcagggtggactatttatgcaggcgttatttgtatgatttttgtgctcgtagtgccttatcccaaacgaaaattgctaacttagtatcgtttttcaatagtaatttatcagtgagtcagtgttatggatactcagcaggaacgtttattacagcttgaccgcgatctgaaaagcgggaagaatatatgcagttcgggaggtgtgctcagttgttttccatcttctttaaaagaaccttttctgatgcaggggcttggtttgattgtctgccggcaaggtagtttccagttttctcttgataataagtgcgcttctgccaaggcgggtgagaccttgtttattcatgaggaatcttgggttcaagtgcttcaggagaccgaagatgtggaaattcttattcttgcctatcagatagaaccgatacgtgacattatcggcaactccgtggtttccatgtatatgtattcgaaacttactccggaactctcttgtgtatggaataccggcgaggaagatgagattatgaagtatatgtctttgatagacagtgtgctggaaatggaggagagtgtgtttagcctttatgagcagaaactccttctgctggcactgacctatcgtatttgttcggtctataaccgtaaattgattagtgccggacaggaaacgggcgggcggaaaaatgagatatttgtccgtctcatccagttgatagagcaatattatatgcaggaaaggagtgtggaattctatgcggataaactctgtttgtctccgaaatacctttcggctctttccaaaagcatctgtgggtatacggtgcaggaacttgtattcaaggcgattatccgtaagtgtatctctttgttgaagaatacgcaaaaaaatattcaggagatttccaatgaattcggcttccccaatgcttcttattttggcacattcttcaagaagcaaatggggatgtcgccgcagcaatatcgaaggaatctttaatcgatattactctttttctccataagccagatcgcctgcgtcgcccagccccggtacaatataggaatgttcattgatttcaggatcgatggcagcacaccaaatggttgttttgtcttcgggaaatacgctcttgatatgatcgattgcatgttggctggcaatgatcgaagctacgtgaatttcggcgggatggcctttggtaagcatggcctgataactcagttccatactgccgcctgtagccagcatcggatcggtgataatcagcgttttgtcgtcaatacgcggagatgcgatatattctatatgtatatcaaatttcagggtatctttatattttcgataggcggacacaaatgcattttctgctccgtcgaaatagcttaggaagccttggtgaaaaggaaggccggcgcggagaatggtgctgatgacaagctggttgtccggtgtgctgacgggagcaatgcccagtggtgtccggatgttttttactgagtatcggaactctttgctcatttcgtaagccatgatttctccgatccgttcaatgttacggcggaaacgtaggcggtcattctgaacttctacatttctgatttcggatatgtactggtttagaatcgaatttgtttggctaaaatcaattactttcatattatagtttaatcataatttaatctcattttcatcgtattgagaacgttctggcttgcaaagtaaacgataatctttcaaattgcaatattcagtttgcagatattgttaggaatttataaaagagattcaattagggaaaaatttctctaatcccttcttccttttcaaagaaagtattacttttgtacccggatttacaaggaggcacccaaagctcctcatgttcaggtgaaaagagataataaaacgaaataccaattttaattaattcaaaaaaaatggcaaatttagatttaagcaagtacggtatcacaggtgtgaccgagattgtgcacaatccgtcttatgacgttttgttcgctgaagaaacaaaaccaggtttggaaggttttgaaaaaggccaggtaactaacatgggcgctgtaaacgtaatgactggcgtttatacaggacgttctcctaaagataaattcttcgtaaaagacgaaaccagcgaaaatacagtatggtggacttctgaagaatacaaaaacgacaacaaaccagttgacgctaaatgttgggcagctgtgaaagatttggcaactaaagaactttctaacaaaagactgttcgttgttgacgctttctgcggagctaacgaaaactctcgcttgaaactgcgcttcatcatggaagtggcatggcaagctcacttcgtaacaaacatgttcatccgtccgacagctgaagaactggctaacttcggtgaacctgatttcgttatcatgaacgcttctaaagctaaagttgaaaactacaaagaactgggcttgaactcggaaactgcagttgtattcaacttgactgaaaagatccaggttatcctgaatacttggtacggtggtgaaatgaagaaaggtatgttctcttacatgaactacttattgcctttgaacggtatggcttctatgcactgctctgctaacactgataaagaaggcaagagctcagctatcttcttcggtctgtcaggtacaggtaagactactttgtctactgacccgaaacgtttgttgatcggtgatgacgaacacggatgggatgacgaaggtgtattcaacttcgaaggtggttgctacgctaaagttatcaacttggataaagaaagcgaaccggacatctggaatgctatcaaacgcgatgctttgttggaaaactgtacagttaacgctgaaggcgaaatcaacttcgctgacaagtcagtaactgaaaacactcgtgtttcttatcctatctatcacatcgaaaacatcgttaaaccggtgtctaaaggtcctcatgctaaacaagttatcttcttgtcagctgacgcattcggtgtattgcctccggtatctatcctgaacgcagaacaaactaaatattacttcttgtctggttttacagctaaattggctggtacagaacgtggtatcactgaaccgactccgacattctcggcttgtttcggtgctgctttcttgtcactgcacccaactaaatacggtgaagaactggtgaagaagatggaaaaaactggtgctaaggcatacttggttaacactggttggaatggtactggcaaacgtatctctatcaaagatactcgtggtatcatcgacgctatccttgacggttctatcgacaaagctcctactaaggttatgccttacttcgactttgttgttcctacagaacttccgggtgttgatccgaagatccttgacccacgcgacacttacgaatgtgcttgccaatgggaagaaaaagcaaaagatttggctggacgtttcatcaagaacttcgctaaatttacaggtaacgaagctggtaaggctttagttgctgctggtccgaaactctaagccttttaggcaatagatatgtaatgcaaaatgtgggcggttccgaaaggagccgcctttttttgtttatatgaaggtgattttgtatctttgttaatctgaattatgttcgataaaacgctgacaaatacatgattattacttatttgaaactcttttgtacattcgcaaaaatcggcatgtttaccattggcggaggatatgccatgattcccttgatagagcgggaaatagtcaagagaaaatggatgagcaaggaagaatttatggaaatgtttgccttgactcaatcgttgcccggagtttttgcggtaaatatatccattttcgtgggatataaacttcataaggtcagcggaagtctggtttgtgcgttggcgactattctcccttcattcgtcattatgatgttgattgccatgttctttgcccgttttcaggacaatgaggtgatgattcgtatctttaacgggatacgtccggctgtagtggcgctgattttgtttccttgtatatctgcggtcagagctttgcatttgaagtatgtgcaactgatagctcctgtgattgccacagtactgatctggcaattcgggctttctcctatttatgtggtattggcggggatttccggtggattagtgtatactctgtggttgaaaaataagattaaagatataaaggcatgatatatttacagttactttgggtgtatctgaagataggtacgtttggtttcggaggtggttatgcgatgctttcgttgattcagcatgaaattgtagatctccaccattggctgactccccaacaatttacggatgtggtggcaatttcgcagatgactccggggccgattggaattaatagtgctacttatgtgggctatgcagtgacacacagtgtatggggagcggtacttgctaccgtagcggtgtgtctgccctcttttattctcgtattgctcatttcctatttctttgcgaaatgcaaggataataaatacataaaagcagcgatgtccggcttgcttcccatgtcagtggcattgattgcctcggctgccttgttgatgatgaacagggagaattttattgattataaaagtataggaatctttgctggggcattccttatcacctggaaatgggatttgcatcctattctgctgatttgtctggcaggtctggtgggggtgatcttgtattaaaaaaactttttataaagctagggttggctactggatcgtaaagaagttgcttaatatgcatgaactggaaatagaaaaagcccgctaaataaaatccggcgggctttctgcattatctcgggctattgcttatgatttgttcgcgcgtttacgctcgatttcgtccagaatgactttgcgcatacgcattgctttcggagttacctctacgtattcatcttctttgatgtattccaatgcctcttcgagtgagaactgaacaggcggaatcagacgaactttgtcatcagatccggaagcacgcatgttggtaagctttttggattttgtaacgttgataaccagatcgttgtcatgggagtgttctcctactacctggcctgcatatacttcgtcctgcgggaagatgaagaacttaccgcgatcctgcaatttatcgatggcataggcaaaagcagttccgctttccattgcgatcatggaaccattggtacggtgttcgatttctcccttgtgcggctgatattctttaaaacggtgtgccatgatagcttcaccggcagaagcagtcagtacgttggtacgaagaccgatgataccacgtgaaggcatgtcaaattcaaggttgatacgttcgcccgtattttccatcttcaccatttcacctttgcggcgggtaaccatatcgataatcttgcttgaatattcttccggtacgttgattgtcagttcttcgatcggttcgcacttgacgccgtcgatttctttaaagataacctgtggctgacctacctgcagttcgtatccttcacgacgcatggtctcgatcaatacagaaaggtgaagtacgccacggccggaaacaatccatttgccgtcttcctcactctttcttacacggagtgccagattcttatcaagttctttcatcagacggtcgtggatgtggcgtgaagtcacgaacttaccgtcttttccgaagaatggagagtcattgatggcaaatagcatgctcatcgtcggctcgtcgatagcgattggcggtaatgcttccggattttcgaaatcgcagaccgtatctccgatctcaaaaccctcgatacctaccaatgcacagatatctcctgatgaaacttcgtttgtttttacacgtcccaaaccttcaaatacatgaagctctttaattttagatttgaacatatcgccattacgttttaccagcgtgatgttcattccttctttcaaggtaccgcgatgtacgcgacctacggcaatacgaccggtataagaagaataatccagagaagtaatcagcatctgcggagtaccttccagttgttcgggagcaggaatattttcaataatacaatccagtagcggggtaatggtatctgtcggcttttgccagtctgtgctcatccagttatttttggcggaaccgtaaataacggggaagtccagttggtcttctgttgcgttgaggctgaacatcaggtcgaaaaccatttcgtaaacttcttcagggcggcagttaggcttatctaccttatttactaccacgattggtttcaaaccgatttccagtgccttctgaagtacgaaacgtgtttggggcatcggaccttcgaaagcgtcgactaacagaatgcagccatctgccatattcaatacgcgttctacttcaccaccgaagtcgctgtgtcccggagtatcaatgatgttaattttagtaccgttgtaattgatggatacatttttagaaaggatcgttataccacgttcacgttccaggtcgttgttatccaggataagttcaccactattttgattgctgcggaatagatttccggccagcaacatcttgtcaaccagcgttgttttcccatggtcaacatgggcaatgattgcaatgtttcgaatattttgcatataatacctattatttggctgcaaaggtacgaaaataggattagaaataaatgcaatagccccattttttcttgtaaaacgttgtgagatataaagataatgtctatctttgcacgctcaaaagaataatttactatatcaaaattctaaaaattatgtatttagacgcagctgaaaagcaagaaatctttggaaagtacgggaagtctaactctgatactggctcaactgaagcgcagatagctttgttttcctaccgtatttctcacctgactgagcacatgaagctcaacagaaaagattatagtacagagagagctttaacaatgttggtagctaaacgtcgccgtttgctgaattacctgaaggacaaagatatcacaagatatcgttctattgttaaagaacttggtttgcgtaagtaatctacttgccgcgaaaagattaaaaaccgtttctcacattgagaacggtttttttattggctttcaatgaaggattagtattttatgctgtgcatattgattgcagccggctgtccgttgtatagtgcttcacaactaattgtcaggaatgtagacgagttcgcattattacagcgaatgatggctactccattttcgtcggtggtaactttagggttccaatagattgtacggcggtggtcattgccttgtcctttactgatatccgggtaatagggtgaataaaattcaatgggctgggagtaaccttggatctgtgtgtttcggataccacgtgattggtacttcttttccgggtcccaattgtcgatggtagtgatatagcaaattgcaaattgatttcccggttgattattgggagttgtgttgttcagataacttttgagagctttttcttcaaagggagagagtctggaagtttccatgtgattttttagactttcgtcgctcaggtgataagcgctgtcgtcatcaattccggcacttgctgtcgtgccgtcgcaaatcataacagattttatcgcatcgatatttttatctataaaaagctcccgatcaaatgttgagtaaagaactccatttatgacgcatagtatataatgattcttgtatttcatggttataaatggtggatctcccttccacttagacttcacttgaatattgggatttaatgtggtcattagccaagggaaatagtccatgaattttccttcatcgcgcattcgatccagttccttagggatatcataataagctcttacagattgctcgaaagctagaatttttttgtatttcgtacgtttggctttaatcgttacctgatccaacaaatgagtatcgtgtcccataattgaatctagataaagagagtcggagagactgctccaccaactgagtccgctaatatcttcccatttaggatgtagctcttcgtaagcgtatttgcgtagttcgggtgtaaagttgcggaaaagtgatatgtttgttttccggttcagcttttttcctttacggcgagtttgaatagccgcactcatggaaccattgaaggcatccattggaatttggaagaatcccaaagagtctgtgaccgtagtacctgctgctgatatcgtatctctccgggcaatgacgcttacagagatctctttttgttctttgtttctcagaaaagatgttacctgtccatgtagagtcagtctcgtttccggcagatagattggtgtttctggagtggcactgatggcttggcttatatcatattttctccatccgtgaatcatcaacagaatatctaatgccactcttcgtctgggagaattgtttgcgaaataatatccaggttgatgaatgtatcctttcagatctgatgtaagtaaaaggtctgtgtaaattgtctgatcgaaccgttggaagtctgattttaaagcatcccgaaccgctacggagaaatgtccttgtattggttgacctgtatggtttttcattgagatatgatactcaattggttcaaaaggatagtataatgcattggtggatgtggctgttaactgtaaagatggagaaggcatcacatagcaaaaacgctcgcataacgttgccccattgctattcattaaagagagttgtatgactcctcccggcaatccctgagtggataacgggagatgatatactgtttgatctttaaaatcaagggtctgatacatgagcggacgtccttgatgtgatatgaataaagccagtgtatctttgagacttgtcgaatttctgagaactttgatgactaatgctttttctttagacgtcacatttagcacatatccttggggtaaagccttcggtagctgaaatgagtattttttatcttgataggtcactacagctttggcttgtttgtctgtaggggtgtatgtaaagcatcccataccgtcgtggagagttgtaaattgtgcaagttctacatcatccggcccataaacagttcctgaaatgcctactgtaccttcttctttacttgtcgcttcgaatgcaacgactgaaggtactccctctactaattgtccaccttccgggaagaatcgaatcatgaaatctttttcttttgaacgcggacgttgcttcatagattcatccattcggtaagtgatgatgctccggttttcgtctacttcgcttctccgttttctatatacagggatcgtacgcgagaaatattgcttttcactgaatgccaacatccatttcgtataagccctgatctcgtaaaaaccggagaataaggcttttgtcagtatgaattgtccttctccttctccatcccgcaactgtatgatttgccgttcactagtatttcccagttggtctaatagctcaacataaaggggggtactaattgggctaggttggttttgctcggccgttactacgtatgccttataccatatcgtgtctccgatgtagtaactggtgttgtccaagtgcagataggctttctcgcgtggatatgcatcggcgtaggcttgagaacgggcaaagtaagttgcgaatatagaatccgcaacttgctggctatggatttgcacggctatacttgataggaggcagaaagtgatgattatggagcgtattctcattacattttgaatgatcagtaacttgaaggttggggaacgtcaagtgttagcataactatacttgtttgattactaactgttgcgaaatgaacagttgagccatcgtaatgactggagttggaataatttgtgcgataagcaaatgatacttcatctccttttgtatcataagaaaagtatccccattgaataggggagtctttattccaaggatcatagactgcagagaccgtaatgggttcccaataaccactgcctgtaatgagtacatcgcatgccatagggaaaggtatatcgggtggaaaacgaaaacaaatagaaccatacattgaattaactttagagaaagtgtactcttgcttatcaaaatcatatccgacgaagtttgcatagggattccatgggcctttatcaggatatggtcgatcatacactaactctgagcaggtagcacgaaccgcaatatatcctcctccttcgggaagttgtagatcggttacaggtatttggattgtttcataggttccttcttgaaccaaaacttcacggacaggaaagaaggaatattcaactggattaggatcaaaatcacgacttgctcctaattgaatctgatcatatttcccttgaccttgtcgtatctgaatatttagcaaaggtggaaatggaatatattgactccattctattttaataatctgaggtaattttgcatgctcaaaatactcgtcctggctcgttcttgttgttaccactttactggtcgcttctatactaacagggctgtcttccttcgtacaactgcaaaaaatgattgagaggaataatactaatagtaaatggattctttccttactacttgtgaattgattgtgtgtgttcataagctatatattttagaggcttaacaataactacttatgatctatgattatgcaagaaaggaaaaaataatgaaaatatgaaaattccgagtttaattagtgttaatctccagtctatatattacttaatccattttcaaggcaggtaggtgaaaagagatatattatgggagatattttaggattataattgtgttcatctaaagattttgctatttttgcaacctaattattctaatttatcacctttgctaactaaaaaactttcaatatggatacgagtaagattgttggagagaaaattaaagcgctccgggaagataaatcaataagtatagaggaattggcacagcgttcgggtttggctatcgagcagatcgaacgaattgaaaataacatcgatataccgtctcttgcaccgctgattaaaatagcgcgtgtgctgggggtacgtctgggcactttcctggatgatcaggatgaaatcgggcctgtggtatgccgtaaaaaagaggctaaagatgccatcagcttttccaataatgcgattcattcacgcaagcacatggaatatcattcattgtctaaatcgaaagcggatcgtcacatggagccgtttatcattgacgtgatgccgacagaggacagcgactttgtgctttcttcgcatgaaggagaagagtttatcatggttatggaaggggttatggaaatcagctatggtaagaatacctatttgctggaagaaggtgatagtatttactatgactccatcgttcctcatcatgtacatgcttacgaagggcaggctgctaaaatattggctgtagtctacactccgatttaataaaatctgataccaaatattaagaataatcgcatgcaattatttgaacgtactcttgggcaatggctggaacattgggctgaagagactcccgataaggaatatatcgtttattccgaccgtaatcttcgttttacatggagccagcttaaccagcgtgtggatgatatggcgaaaggactgatcgctgttggtgtggaacgtggtactcatgtcggtatttgggcggcgaacgtgcccgattggctgacattgctgtatgcttgtgccaagattggtgcggtatacgtcacggtgaatacgaattataagcaggccgagctggagtatctctgccagaattccgatatgcatacactttgtatcgtcaatggtgaaaaggacagtgattttgtgcaaatgacgtatacgatgcttcctgaactgaaaacctgcgaacgcggtcatttgaagagtgaacgctttccgtatatgaagaatgtgatatacgtcggtcaggagaaacatcggggaatgtataatactgcggaaatcttgctgctggggaataatgtggaagatgaccgcctgactgaacttaaaagtaaagtggactgtcatgatgtggtaaatatgcaatatacatcaggaactaccggtttcccgaaaggagtgatgctgactcattataatattgccaacaacggttttctgaccggcgaacacatgaagtttacggcggatgacaaactctgttgttgtgtgccgctattccattgttttggagtggtgttggctacgatgaactgtctgactcatgggtgtacacaggtgatggtagagcggtttgatccgttggtcgtgttggcttccattcataaagaacgctgtacggctctttacggagtgcctacgatgtttattgccgagttgcatcatccgatgttcgacttgtttgatatgtcttgtctgcgtaccggtataatggcaggttcgttgtgtccggttgaactgatgaaacaggtagaagaaaagatgtacatgaaggttaccagtgtatacggactgactgaagccgctcccggtatgaccgctacccgcatcgatgattcgtttgatgtacgttgtaatacggtaggacgcgactttgaatttacagaagtcagagtgattgatcctgaaaccggcgaagaatgtccggtaggcgtacaaggcgaaatgtgcaatcgtggatataatacgatgaaagggtattataagaatccggaagctacggctgaagtgattgataaagataacttcctgcattcgggcgacttaggcattaaagatgaggacggaaattaccggatcacagggcgtatcaaggatatgattattcgtggtggtgaaaatatctatccacgtgaaatcgaagaattcctttataaacttgatggagtaaaggatgttcaggtagcagggattccctctaagaaatatggtgaagcggttggtgcttttatcatcttgcaggaaggggtggaaatgcatgagtcggacgttcgtgacttctgtaagaataagatttcccgttataagataccgaaatatgtcttttttgtgaaggagttcccgatgacaggcagtggtaaaattcagaaattcagactgaaagatcttggattgcagctttgtaaggagcagggaatagaaattatttaaataaagaattaaaaaagaagaatgaagaattagctgcgctgtatgctgcatagcaattcttcattcttctttttttagttcttcattcttaaatgaaatcgtctcccagttgcatctgggcatcattcacgtatttgcggatagaatgttcttcgtctttacggcagattagcaggacattgtccgattcggctatcagatagccttccaagccatcgatcacggcgagctttcctttggggagtacgatcatattatcttttccattatagatcaaagaatgactttttaaggtcacattgccttcccggtctctttctgataagtcgtagagtgatccccatgtgcccaggtcagaccagccaaaatcgcctaaagatacatatacattgtccgctttttccatgatgccgaagtcaatggatacattgggacatgcgggaaagttttcttcaatgaatgctttctctttatctgtagcatagatattttttcccggtgccagtttggatactaattcgggaagcaggatttctgcagctttaataatggtattgacgttccacataaataatccggagttccagtaaaattcaccgctttctacgaatactttggctaattccagttccggtttttcggtgaatgtctttactttgtagaagccatcaccggttggttcgtcaatttgtatatagccatatccggtctcaggacggttgggcttgatgcctagtgtcagtaacttttcagagtgagaaacgaattccagtcctttaatgattgcggcacggaattcttcttctttcaaaatcagatgatctgagggagcaacgacgatattcgcattcgggtttaaagcgcggatgtgataggcagcccatgcgatgcatggagcggtatttcttcttgcgggttccaataaaatctgtttctcatccaattcgggaagttgttccttcaccagatcggcgtacattgcattggtgacaataagaatattttcggttgggattaccttttgaaagcggtcgaaggtctgttgtaggagtgaacgaccggttccgaagaagtcaagaaattgtttgggcaatgttttgcggctaaacggccagaagcggctaccgataccaccacccataatcacgcaataattatccatgtttgtcatgatagtgactctatttttaaatgtttttgctaatgtacggtttattctctaaatacagaagcctttgggacatgttttattattttttgctccttttttttctcaaactattgtggaatcaaaatattgtcgtatctttgcaccgcaattgagaaatcaagcatgcccagatggcggaatcggtagacgcgctggtctcaaacaccagtggattcacttccatcccggttcgaccccgggtctgggtaccacgaaaagctaagaattgagcaatcaattacttagcttttttgttatagggtatttctttctaatgtgcactaccagaaggttttcgatattttctatagactgtgttatttgcagcaaaaatactaaaaaggtgcaattcatcgtaaaagtgaattgcaccttttcttatctctcagcatcatttatcccttgcctacctttatccaggttgctttcttccatagccattctaatggaccctggcgatgtgaacgaagccaccagttacaaaaaaagtattgtaaaaagaatacgcttacaccaataaggatacacgctgtaatgcctgtatgcagataaagtcctaatccccagttgtaaaacaagaaccctccgattaaagattgtgacaggtagttggtcaagctcatgcgtccataaggtgcaaatttatgaagaacattcttaagggttgtcaggtaataaaccagtatgatacctgcaaacatgattcctgtaaatacaatatttgacagtgacttgcatagaaggacagaaggtacaagtagtgcttcgcgacttataaagtcggggagtatatttatcaaaccataaatggggaaaaaggcggtaacggctatgatgaatactttaatccagatttttatattcttttctgaatagagaaacgcgttgctacgcccaattatcatacctaccataaacagaccggcggtttgagtaactcttccgtgtaatagcatccaacccatgttggcaacattacccgtccatatggcagttttgcacatttcgaggaaagaaccttctttctgagctgtattgactaactcccagtatggagcatcaagatcagcattaataacatagtcggggttgataagtgcataaattatttgtcccaattcaataggttgaagtagaagaatgactgctatgatcgtgactgttcgggtagagagtcggcagactgcgatcagtacataaccaagcaaggcgtagagtaccaatatttcacccggaaataaagccgaattaatacaagctataaaaagaagtaatactaatcgccaggcaaaccgcccacgaaaatctttccctttaagtttttgtgaattgtcttgaataaaaaaactaaatccaaaaagcaatgcaaagatgcagtatgccttaccggaaaaggtgaaaaatacactatcccaaattaccctatccgtaaatatcagaaagttacaggtctcttccggaaagctattgaggctaaaccgttcgataaaatggataagtgtaattcccattacagcgaacccacgtagcacatcagctatttctatacgattattatggggcaatgtgttagataaatgcatgctttttagaatttaaaatgttaacgtactttttcagatgcaaatttaacgcagcccttttatagttttggaaaaatactgttcaataaagaacaaaatatgacttttgtgtgctttgtatgattgataatgctgtttgtcttttatagttagcctgttgataacttcctgaatattaatgtaaataatgaaataaaatgctatgttggtcttattaaatagaaacaacttgtactgaatacatttctaatgaaaggtatacatgctattgttttgtttaatttgtgaggggttagtccaaatttaattttgtagtgtgggttaataaagtataactgttcattgacgatttgataatcagtctgttttactactcttcgaaacatttctattgtacatcgggtgtatttgatagttaataactctttgactgtgctttcttgttcgctgaataattccaatatccgtttatacaacatacgaggtagtaaatgtataaatggcatatgagagataatcttacttcttgcaatttgctgatgtccgccgaatggcatttgccaggcaggaaaagcaatgaagatcattccgttaggcgatagatatttttttaagttgcgcagaaattgctccttgttgtcgatatgttctattacatcatgtatgagaataagcgggaaatgtttctgtagatcttttaataagaagatatcagaagcgatgaaagttcctttttgccttttagtgatgaagaagttttgtgcctgttcaattcgggatgcggcaatatcaattccaatgacatcacaacctagctcggcaaagggaagcagattccctccttcgccacaccctacttccaatactttgtttggcagatttccagtatattctttaatataaggaatataataatttctcgtagtctgagcttgttcctcaaaataacgttcacggtttgtatgtcgtttctgcatctgatttgtctattgtttctaactgttctatagttatgataaactatcagccggaagactgcatggagaatgaattttttaccaagagaaacgaatgcctacaggaacagagaacgtaaccggatgttcttttcggattgtgcgcaatgaacttccatcgggaatatagtaattaatggttggctctatatagatgctggtgtgaggtgtaaagtggtattgtacacctgtactcgcattgattgaccattgcaaaggtacatctaatgactggtaacccaaattaatggggacactatctgtgacatgagaagtatgcagagttccttttatcgggatttccatttgtaaaccggctgttgagtaaaatgagaattgtttataattcccaaaacggtaggaaatacggagaggaatacctatgtaatggagcttctgggttttctgaatccgatattcctttcctgtggtgaactctgattttaaataaatatattgtaatccggtttctatactccagtggttattcaactttttgttcaatgctagtccgatagtgatggggctattatggtgttgatgttctataattcttccactgttgttcttggcaattgtcattagcgtaagcgagtctcctaaggttccttcctgattgcgggtgtttaaatagtcataatattcttcccaagtattgacttgctgggggagaccgctttccaaaccgtcagagtgtggtgttgtcatcaacttgtataggttttgtgccagttgtggtccgactgaccctgccaacatcattttccatttccctattttctttttggggagtgaagtgaattcttggcttgaatatgagaatgtaataattttctctgcatgctcccatgtaaaagatggtttggcaacaggctgtttctctactgagtcttttatttcagaagtggtagataatcctgttgcacttgtgtctaatgctaaccgggggaggtttgctaaagtagtattaaaaggggggtcttctttgtagtgagagatatgtccggaagaggtaatgctctcattttcttctttcttatctaatttcactttccgaatgacattgttagaccaatgattatctttagtctcttttcttttccagtatagatagtcgtgtatcgttgggaaaaaaaataaaatcactagtataagaatcagcctgtaatcagaaatcatctttttaagtaagacttttgccctgaataattgagaagaggaggagtggggagctatattcaacagtttacctatttccttgtgagataatccttccaatacagctaacttgaagattttgctgtatccttctggcaatttctctaccatttctgttattttatcataaggaatagaatcagatgatagcggattatcaataggctcctcgtcttcagggatatcagataagggaattgcagagtttgtactcttttggttgagataccttaatgaaatattcttcataattattcccatccagctttccagtttttcgggggtacgtaatgtctcaatcgaagtgaaaatgacaatgaatccgtcgtgtaggagatcttgtgcgatttgtttatcaggtatataatgaaggcatattctcatcatctttttcgaataggttttataaagtagacttaatgcctgctcattcccttttttacataaatctacaagttcttttatatccatgtgcgtgtattattttaatatgatgaatagaaaccgaaaagactgcatgctttttcggtttttaacatcttgttttttgcggatatgaagaaactttttgttgataaattgaacttgaatccataaaactttgacgaactttcaattattatgcaatctttgtgctctatacattttttatttcccgacaaactgctaactttatcatcattattataatgacatgtgaatagtcggttgtaccattatttaaatctcgtttatgggtaaatacaaatttatagaagaaagagtggaaacaatgtcttcgtcggagcttaagatattcttgaatatactgaagagcagatctaaggaattgatgtcaactctggagtcagtaaggggaataaaagatttggaggctgtttgtaaatcaactcagaaactaaacaatcgtgtttctgagtttgacggaggatcttttcttatattagtggttggacccgtgaaatcgggaaaatctactttagtaaatctcatagcacatgctcacgtcagccccactcatttcttggagtgtacggtgcgtccgtccattatttcaaaaggacaggaggaatccattacccgtattttttctgttgctgataaagctagaaaggtagaacagtttgattcggtcattgatagcctgcgcggatttgaaaaactggaaaacatttccgagataagcattgaaaagaaagaattgaatgatgctaatctggaggagtgtgtttcgttagctttggaagaaagcgtgataaatacagatcatacgctggtgacatccataacaacttccggtggggagcttttgaaagataatatatttctggtggatatgcccgggctggatggcgggtatgcgaatttggataatcctatttatgaaacgatctctcaaagggcagatttcgtgatatttgtgcaaagttcaaattctgctatatcgaaggtttctaatcgttttctgaagttgctgcaggagaataatccgaaagttccggtttgtcttctacataatgtgtttgaagcggcttactggcattcggaagaggagaagcaggctgtaattaaggcacaggtagaatttgccgagaatgaaatgggcagacgtaacttccagttgaaggagaatatatatagtttgaacttgggaaaagtggcggatgctgccagctatgagggaatggaggatcttcaggaagaagctgcgaaatttcagagatttgagaaggatttgtatggcaaggtgatctccaatagtactgatatacgcctgagaagtgtaattggaagaacgctgaatcagttggaaaaactggataatttagtcggagaatcaattggtcaacaggaagcaatcgatatagaatatcaggctgcggcaacttcgtttgacgagttactccgtcaggcgagtgaacttagttacgatgggagcgattttagaaaaatggtgcaagtctatatggatgatgatttgaaagagtttactgaaatcgttagggagtattatgattccggatgcaattccgcatttgccggtggagcgaaggggaaagatgcgacacgcagccttgttacaaagtttatgactgattcgtcagcggcgataaaaagtaaattccttgattcccatgaacatagcctggcccggcagtatttgcggaaactctctaacttgaaagatgatgtggcttttatagagaagatgaatacttttctgaagcagaaaggttgtgcaccttttgactcagtgccgcaagtgacggattttccggtggtcgattttgatttgcagggagcttttgatgtgaagaatattagtaatccgactgttccgcatatcggaatccccaatccgttcgggacttattcgacaatggaaattcagagttttctgaggaaagcgatggaatgtatcaccggaatcgatcatacgcataccgggaaaacgatcaaaggatatcttcagctgactgtcgggaagagtatatataaggcggctaatgacctttacgatcagtatgtgcctgtacgcaaacaaagtatcattgattttttggaacaacaaaaaacaatgtatctgaatgcgctggtgtctgataaagaagaatttgacaggaaggatgcgttgcttcggtcaataaatgcacaagttcagagttttaaggattcaataagataagaataagccaatgaaacgaaatttattaattatcacactcctgtttttgggctcttttgtgattttattgttgggtaacatcattattattggtgagaaaatagcctccttatcgcaggttgcgtgggcagagtatgctttttacaccttgattctggttgtattttatgccgtcgttatacgtccggtcgttcgggtgcatcgtgctccgcagattccggctttatctattgatggggagtggaatattgcacaacttgttgcgtttggacataaactggcggataactgcaattatatacctaaagataagtcctgtcccgagttgagaaaactgcatcagcaaagattgcatgaagatttggaacgctatgcaacgagtaaggaagaactggtgcaaatcataagcaaagagttgaaattgcgcattgaagggggagaactgaaagagacttcaggtccgcgtatagaggatatgtattcggttcgtatcatcggtatcaatcgtcgtattatagaatgggcaaaatctgtctttatgattacggctatttcgcagaatggaaagctggacacggtatccgtgctttatatgaattataaaatgatagaggatgtgattgtagcttccggcttccggcctacgaggcaacagttgttccggcagtatgtcaatattctggttacttcattaatgacatttgttgtatccgaagtatttaaagatatgggctcggttgctcccttcggctcattagcggatcaatcttcggatgcagcgtccgatatcgatatttccgatgcttctgttgacgctgccgatgttgatttggatgacattggtgataccgtttcgggagataccggctttttgagcattctgtctaatgtgaaaataccgggtgtagtcatcggctcgatatgcgatggaatcgtgaattcgttgatgactttgcgtatcggttatgtgacgcgtaactatctgattgatggaatgaattcattaaatggaatcaaagccaaaagaaaagcaaagcgtgcagccgtgaaagaggcgttgaagtctttgcccaaagttgtcgtggtaggtacttctttcgtgggaaagggggctatgaacattattctgaatattattggcgggaagaaagtgaaggaaactgataaaacttgattttctctttcaacctgtcaccgccttctgaaactctttattcatcagtagtgtatgctggtgataggtcgcagaccatctgtcactgatctatcacctgtcaccgtctgcacacacatatatttattctctttttgctttaatccgtaccacccgatacacattacctcgtttggtatgcacagaaggcacccgattcttttgtaatattcttccgaactgaataatattgcaatcggatacgcgaatcttgctatcatgttgcacctgctccagaatttcgatggcaaggaattgttcgcattcttctccttctgtggctgcccggaaatactcatggaataattgctctgcaattggcatcacttggaactcctggttactttcattcatcaccttctcatcttccggatcaaaccaataccgttcccccttgtatagatcatgcatcgcctgtgcatagagctgttcgtaatcaattggggaacaatcgattggcccggtcacatcgacaacaatataacggcggctaccggaagtgtctgtcagcaggtctttgtgattgctcgtcccaatgaaggaggcgtaacgacgcatctcttgcgtagccgtaccgtgtggacggcggacattgacaatcggtttctgaagaatatgtttcaaaaaagcctgttgattcactctgttctggtcaaattcgtccatattgatcagtgcgaaccgattgagggatatctcggcatcccgtttgttactgaaatcaatgcggtccgtgtaatatgcctgtaattcgggaggaagtagactccggcaaaaagtagacttccggtaagcctgcggacctacgagcaatggtacggtgcaattcgcatatttccggtctgtctgccgctaatgtgccaccatattcagaaaccagcgatagaacaagtccgcccaatgtcggttgttgcagggaacccgggctgctagttcgcgaatccggtcgtgcccgtcccaacgtacatccagtccgaagagaaaatcttcgatcggattgaaaatcggaatccggtcggagtccagataacggaccacatccctgtcccaaagactgagtccttccagccttgcgttcatggcgatactgtttcgaacacggctgctcaggggacggaagtagaaacaaaacgtattccgttcccgatattccgttactgtcgtcattgtattgtaacggaattcgtatctgcgttgcataaattcttccgttcgcagctccagttcctgttctgccgacaggggagattttttgccgaagcctttggcgatggtgtatacactctgtactgtctggcggatcagaaactcttttttctgcctatataaatgagcgattgcccaacgggcggtttcttcttccggtatgcctgcctggaagcaattttcggctaactgaaccaataaaggcttcaagtcttcatcggatcggggatatatccccggctgaagttcgcttaaagattggcatgccttgtttaaagccacttcgaagagcgcagacaatgtttcaagactgtcatatccggggatcaatcgcttgaatggcgatgtttccgcctgtacggcttcttggtaggtcgtttccgagggcatttccattggctggcgcatatacataatggtggagtcgggattgtaataaagttctgggtcgtatgtttgccggcaaaattgctctaatgccggatttttcaattcaatggaataggagagtatcggctggtataagctgacagcttttctataggcatgcgcttgaaagatttccgcttcttcccggtttttgggaagtgatttgtccggtcgtgtgaaccgtacccatatttttacggaatgtccgctggaacccatgaaagcaagataagtctgcgaaagctcttccgcttcctgcttcacccggttcacttccatcaagtttgccagatgattgacttctatttgtatgattccgttgtatgcggtcatctgtatgccgttggccgttttgcgaaaagctgcagccgggatgacttttgccaatttcttggcgtcgtccagcttggcgtccggtgatgcgtaacgtatgcttgtccgtagattgctgatcggttgggctttcgtctcatgcttcatcgcttctatttgtaggtttatgtccaacgttcgcatggttggtgtccctccgttgtcccgcatcaaagtaagtttcataatgaatgtgtctgtaaaatgatctaattattgaatttgttattgttaatgtctttcttccggaaggcatgtaaaggtacgctttattattcggcttcacaaatgtttgtgttgtacttttcttaaagttttttgtatattggttggttcgttgtctattataggtttacgtgttgtctattaatagaaaagttcctttcttcctattgcaaagttcctttcctctaatagtaaagttgcttttgtccgcttacaaactacaaatgcaagttttaattataaaaatgcaagctctgtttttataaatgaagctttcatttataaaaacagagcttgcatttttagtttgcaataggtggaaaggaagttatctattagagaaaaggaagtttagttctaatagtgtggaacttatctattaatatttcaggtgataagtattaatgttttggatgacacaagtggtgataggtgatagatgtggtgataggttcggataacctgtcatcttgtctgcaaatgcgatgaataactgtatgtggaatgacgggtgataggtgatagagaaaaatgagaaaataatctatctattggaattagtggttatagcccgaaacttactctggtactttttttgacgtgtatttcctgtgccggatgactctccatcattccggactctatttgttgaattgcccttttggctttataagcgaactttcctttgggatattgtcgcagatatttctcataatcggttatggtctgacaattgaggaacatgcgttcttcatcttctcttttgactttttttgtgtcaggagcgggggaaactatttctactttaggctttggacgtgaccaagaaggatgctttactactatttcttcctttttaggttgttccggttctatagtatctacacttattggtgcgattactctattcttttttatttcttttttaatgctgtcttctatcagcatacaaattttctgttttacaaactctgcatgagatgaggcaggataacgattcaggaaatgtcggaaatcctctgttgtccggcaggcgttatatctgcgctcttcctcaatacttccgaagaatgcggaaactcctttgatcagcatgaataggaataatatgccaataataatccatcctgccatgcgtttgtttatagtggagagacgaattcttttttgtaaacgtgatggcgctggtgggagtggaggtgttgaagcatgtaccgctgatggtgagtgcggatgatttacttcttgccttagcatagagttagcatagttataagcttgctgagcagtgggacgatcccatgtgttaagcgagaggcatgcatgaagaaactggtccagttggggagaatagccgttatctaaggctgggatacgtgcaccattcagttggacacaaccacccataccttcccataaaatgtgaccggtcagcaattcgtaaatactcatgcctaaagaccatatgtcgctggtacctgcaataaatggtttctcagaaaagtgttccggtcccatataagcaagtgttccggaactttttactttgttagtgcttttacggaatgtatgttctaatttgcggctaatgccgaagtcggaaatgataaatttaccatcatcaccgattagaatattatcgggctttatatcttgatggatgattggcgggttttgactgtgcaagaacatgagtccacatgatacgtcgcgtatgaaatgccagatttgcttttcggacattttaccgatcaaggtagcggaggaaccattagaacagtaaggcattatcaggaatggacatctttcaaatacatcaaaatgattaagatgtaataagttgggatgatgtaatttataggcaagtttgaactcttcccgaaagtcttttatgccgttatcatccaacagaccataaaactttatggcaacttctacatctgccaatgtgtttcgggctaaccagacttctccgaagcttcctgtgcctaattttttctccagctgatagtgttcagcaaatatgtcaccactgttgaactgcatgtgttttgtttgtcaatctggttgaggagagattgttgaggtatctgtttctgtaacaatgactgtatccgtcggaaaaatcttagctttccactttgcggatagctgtgggtttttataaagataacctcccagtaacagggctaaggcaaaaagtaatagaactattttccggaatttatggttattcggtttgctgaatacagtgttgttcagattagctttgggctcgtccgtctctttctggataatatgacaaagtactatcgttacattgtcatatccgccgacagcaagagcggcttctatcagttggtctttacagaccaccaaatcattttgattttcctcaatgatttgcataatctcttcgtcgtggcacaaaccgcatagaccatcgctgcaaagcagaaaaatgtcatcgtcctttagattgtaagagcggaaatcgggattggaacgattggtcggatcacctaaacaacgagttatgacattgttgtaagggtggtcaaaagcattctccggatccagttttccttgatcgaccaagtcttgtacgtaggagtggtccttggatagacggcagaatcccgaattggcattgaacacatagcagcggctgtcaccgcaccaacaaatataggctttttcatttaatatccaggcaatgacaatagtagtacccatgccttgggtactactatcttctttacttgcattgacaatatttaaatcagcggctttgactgtcttggtcaagaattcttcaatagcttcttctgtggccatctcatcttcgagtgttacgatcttgtccagcttttctggcgtaaatgcgttttgcaccgtctcaatggcaatggcggatgcaacctctccggcgttagtaccacccattccgtcggctactaccagtaaagtgccatacttacctaaaggaatggtttcggaagattgaggaatgatccattccgattggcttaaatcccggtttactacaaagttgtcttcgttgtttttcctgactaaaccaacatcagtgcctgccgctaatttaatttttatctcagacataatttttattttatatttcctattggaactaaacggtctttgccctctatactacctaccatgaagccgattacctgatatgttccattttccagaaggaatgctggagaaccataatatccaggttccgccacgcggttttgtaatacgatagttcggtattttgtatcagaaatattagtgtggtcgttgaagtgtgctggagttagattatgaatgtcagcataacctgcatagcctaccatctgtatttcagttcctccattcatgttgtttgctgctgttgtatcaaaaggaagaccttcgccgaaagtacctttacctctaatatatgcccagctatacgcagcaggagtcactatactgacttgtacatagtttctacgtttataagctagctttataccatgctctcttagttgtaccctgattgacttttccacctctatttctgtaaatgtgatgtcatataattggtttctgctaaagtctgcatttgtgaatgttaaaggttttcctgttcccttggtgctataagcacgataatgtaatattatgttacatccggctcctctgtatatggccagtagtctacgccatgaatctttccattcggtattagagaaaatccatggctcaacgttttgtctgtctgtaacaaatgttccgtcagatagcataaaaccggttccgcaaataatatctgatacttgtatgcccggatcgaattttgtgccattatattcgatttcaatatggtcaactttgattgtatagatatgatcgtaataatctttcagatctcccgaagcattatgatcttgttcttctaccacatcggactctacattatcttgatgagtcctcgcctgttgagttgtctgtggcttataactggcttcttctacttcttctgtcgcattttcggcagctatagtacttgaaagattgtccaaatcagattttactttatagaaactggcatttacattgcctaattgattatttacattagctagctgtgactttaatgcttctgtatttccatcgctagttcgtaatttagcttctagttcccgttgttgtgtttctaaagccgcacgttcagttcctagtgaatccaactggttctgataccctcttagttgaacttcttgttgttctgttttctgagccagtaagtcattctttacacccaaactataattccatgcagccagaccggcaacagccaatacgaaaacaatccccataatagttaatgccgttttgtaggggcgtaaggcttgcttacggaaaagactcattctttctgtcaaaccgatactggaagttaacgcttggcgcccttgtggaactataaatcccaagcgtggtcctcctacagataattgtatctcatctccggtttgtaaatagtaagaaccattaatcggatgtccgtttactaatgtcggattggagtgtgagagatgaattagtttccaattttcaccatcacgtacaattgcagcgtgtttgcggctcactgtttcgaaactttcatcaaagcgtacttggcaggaggcatctctacccaactctacttgatcgacaatgattttttgagattcgcctgcctgatgatactttgatggagtcttatgctccagaatgaagtaagttctgcctgaggcacccatcaatgctcccataccggcacctactgagccggctagggtacgtttgtaattttgtgtatccatactacttaatatatagttaatagttttcaaatctcatttttacgtctccaatagatatgatatcgccaacctttagcctgtaaccttgttgggtgacttgcgtggaattgacataagtgccgttgctggattcctgccatactttttgttctttttgccattgtccgtcccgaataatccaatggtcaccggaaggtgtcgtttccagtgtacaatgatggcgtgatacataagtactttgccgctctgttacaggcagcagattatcaggctctctgccgatagtaagtattctgcaaccatgtgtggcaaattcgcttagttgataaagctttccatactcttcgccctgcatgatacgcatgcaaaaaccttggacagtttgtggtgggcaatatcccctttccatagggacctgttgggtctccggcagatatttcaaaacttccttgacggattgaaagcggtttttaaaatcgggattcagacaccctgaaaaaagtcgatcccattctttcccgttttttatctgtactaacttccggcggttccagtctccatcttttcctcgtttttgatatagagccaattcattatgactggttaattcaccaaagggcaggctaccggtcaaaagttggaaggccaatactccaaaagaaaaaatatctgtagtaggtagaactgtggcttcacctcgcatacggttcacttgttcggggggcatataggcataagttccgaatatttgattgggcttgccgaaaatgttacgttccgtcatacgtttatttctatcgcccgctataccgaagtctgtcagtgcagctactccattgctcttaaaaagaacattctccggttttaagtcgcggtggacttttcctctgatgtgtaaagaatgtaggccaagaaggatttgttggcaaatcaaagggattttactgttctgagagcctaaatagggtgtcagatctcctcccgggcaatactccatgacgatatagggattgcctccaaccgtaccatagtctatagaactcaccaaatattcacagtctatctgccctgttttgaattccatttcgaaacgatctgtcaatggtttccgtatttcgggtggaacctcccaaagtcttaatagtttcagcgcatagtccttacctgcgttgtccgtaactcggtatactttaccgaaagaaccttcgcctaatgttttggaaacccgataacggttatcgatgtattctcctacattataatcacatctatcgacagattggttggtcacaatgaatcactttcaaatttaaatcttcggtcacctaatacgataatatcatcaggtatgatctctatttttctgtttgcctgaataaaggttgtccttagttcacttcggtcgagcagataccaatgtccgtcttcgaaaactatttctgcttgctcctttgaggtgatagtccggttggatacttctgtgttttcccggttcaaaatgatcgattttccttcatattccattttttctgaaggaatgttttcattctcttccggaatgatggttaaagaacaatgaggtgtaatatcttccggttctgtttctgctatattttttatctgtcgtcggatagtgggacgatgtacacgaacaccacaatgtgggcaaaatgagcaggtaatatctatctcttttccgcattcctgacaagccattttatcttccggcaagaaagatgttttttcttctatttttttatgtttgtcgtctgcggatttatcggctctttccagaggcgttccacagcaagggcagcttgtaaattcacctactatcggataactgcagttcgggcattctgtagcaggctgtgtgatagcagaatgggtatcaggttcattcaaagtggggaatacaacagtttttctgcacttttctctattaggatttgcatttagcactgtgggtttggggatggcttctccataaccttctcttgacacaaaatcattttgattgttggcgtaaccagtcgaaatactcaatagttgtccacattttagacagaccgttgtatcagatagattgtcccaaccacaattcatacatctcataagaacttattttaattgttgaaccacttaaagtataaataagtcgacgcctaagatgacgattcatgtatagtcatctctaatcatcttaaaatatacctccttttttctgtgagaggatggcggaagaaatttctcctcctttcgtctttagtatcaaagttccttctttggcttttttggttttaccaacttttagaatcagtttgtcactgtcctttgctatgacttcgcaccaacttggaatatttattacttcccattctgtattcgtctttattggtaattctttaatttcgcctttggaaccgaactccaatttgtccaatgctatattgatgaattctttttgaccgctttgaacgaccttgactgtttcttccattttcccgttgctaatggtcacagtggctttacgctctgaagtcagctggtttatttcacaacttacagataagttttttccatgaggaatcactttacaccagtttgaatctgaagttgccgtccattcttccggagcactatctactttgatgtattcggcctttgtcgtctcgtagccaaatcttacagaatccggggtaatggcaagtctggtaacttcgatggcaggggcaggagtggacttgggagccggcttgagtttctcctcgcattccttaatcttacttttgcaatcctgctccagtttgctgtcgcatttcattgctgcttgaaaggctttgatagcttccctgtatcttccttttttcatgcttgtctccccttttttgtaaatggcggcacactgcccccatgtacttattggcatagcaagagcgaagactagaattagtaacttaatgcatttcttcattgttattgttgtctatgtttatatatggttctattttctttgcacgattttcgaaagcctcagctgcttctatttgctcaaacattctcatggtatctgcctttcctgtgaacatatggtatgcagaatctaatatagtttccacttgctttatttgattttctgcaagatccatgtatccttccttagaaataaaaactgaatctttataaagatttacttcacgatacttcttgatagcatttatatagaaatcttcaaaaacggagtcgttattttgttttaaagtatcaatagtgtatcggaaaatgttaccttgacttttgtaattatcgccttctagaatgattgccttgcatatgctatcgttagcattggtttttgaagtcatttcttgttttgcctccggtgtagcttcttttccacttgttgccagatagatagtaacaatggttgcacatataattataatagccgcaataataatgagtttgcgatgctctcttttaaacagcgtagaaactctcttttttatatcggatgattgcataacaggaaattctgcatcagaatgaatggatgagggctcatgattatcctttaattcaaatgaaaaattttcttgtccttctggagtttgaatttcatttatctcatcttttgatgaaagatcagaggtcgtttgttgtgaactttgtatgttaaagggtgctgaatttccattgatatgctggaaggcataatctgcgatttgtctggccgtaggtctgtcccatgtgtttagagcaagacatttataaacgatatccttaagttcttgtgaatactcctcattattaataagtgggatatccgcaccgtttttctgcaacagacctccatgatcaccataaggaggtaaccccgttagcagttcgtacattgtcgcccctaatgaccagatgtcacttgccataataggggtaggggatggaccgaaacgttcgggtcccatgtaagctaatgtgcctccacttagttcttgcccttgatttctacgtaatgtgcttctaattcgtgtactgatcccgaaatcggttatcatatacccgttttcatcattaattaaaatattatcaggttttatatcttgatgaataacaggaggaagctttgcatgaagataggctagtccttcggcaacatcatgaagtagatgccaactttcggtttctgtgattcgattattgtcagtgaggtatttgaatatagacccgtttttgcagaagggcagaatcagatatggcattcgctcccaacaatcatagtaagtaggatgtaataaattggtatgattaatatcaaatactaaagaaaattcttgtgtaaagagagaaatcccggcatcgtcaagccccatacccggcgcatatattttaatggctactttaacatctgtgagtttatccagtgctaaccaaacttctgaaaaaccacctcttcctaattgtttgagtagttcgtatctatctgctataacttgtcctgtgtctaacataaagcttatagattaaatggaaagatatcttttcttacagaggtagtctctccatgcataatttattcgtttgtcttaattagtgctttttattaagtatgtgagattgtcggtattagataatcacataacaatatatgcaaagtaataaataaaaaagtgaataaaaaaatggtgaaaaataggcgttgaactaaaatgcgataatatgatctatactgcaaaatataatgctatgctgtatatttttgttttatgttttgctgactgaaacctaaaatgctgtttatattgtgttttaaaactgtattaagtttgaaatatataagtgatttctaccaaaacatgaaaaaatattgtatttttctatgtctgtttatcatactgtgtagttgtaacgaacaatataatgaaggctacatctcatttggaagctactcttcaattatgttctaagatatttataataaaattaactcataacaatatttgtatatgaaacagcaaatactaatatctattactctcataaaagatgaaattgctctttatgaatggatatttagtatagtccctatgcgttttcttatataaatcgaatacaattacattaaaacggtatgattggggactacatacacaaacaatgaacatatgaaacgaaattatttgctaacattcattcttgcgcttgttatagcaagttgcggaggtagtgatggcgatgaagcggaaacattattgactgtgtctcctaatacgtttacactttcttcggacggagattcacaagtactgaaaatccaaagtaatacctcatggcttataaccggagcttcaggatggttgtctctatccagttcatcgggcaaaggaaatgcttctgtggtattaacagcacaagaaagtaaagatatagatgaacgtaaatgtacacttatagtgcaaagcgaaggaggcgagatttctgaacctgtatccgtagtgcagcaaggagtttctgtatctctatctgttgatgtgaaagaaattaatcttgcagaagcaggaaaagaacaaacattcaatatcacatgtaatacttcttggagtattagcggagtgcctgaatggctgactgtatcttcaacaaatggtgtaggaaatgctgctattaaagtatcagcaaacagtttcaataactcacctgctgatcgggatgttacactcaatatatcctcgtcaggtggctcttctcaatcagtgaaaattattcagaaagccggcttggcagcaggaagtaatgtgacagctcaaactgttgttgtgttgagcgattgttttgctacagactttgagtatggtaacaatgtaacatatttctatgctgtggtgtttgaagcttcattcattgaaagatatacagatgaagaaataatagatgttatgaagacagatgaaaaccgctgtacacctaatgataattatgttatttcattttataatctagagcctcaaactaagcatgttttattccttctaggatttaataaggacggtcaacgaggggagcttataaggaaagaaatcacaacgaagtctggaactaaccagccagaggcgtatgtaagcaatgttacatatacaactagtgaatggtcttggtatacaactatcggtgcgtatgccactaaatattatcaatggattttagaatactcttcaaattactataactcctcagacggtttagttgcttggtatttctctaaaaatataaaagaaagacctaatgctgactttgatccaattttacaatcggggggatggactcgtgctagaacatctagtataacaaaacttcaaactgttacatggggagttggacagagcggagaattaggtggtactattaataactatcattgggaacctaaggccaatggtgtaatgagaataaacgaaagtaataggaatacagcaaaaggcattgctcatatcggtatgattgtaaatgaaaacaccttgtttaaaggagcaactattactcgtattcgttaattaataaataatgttttcaggaacaagccttataagattaaggcttgttcttctttattttagatctaataattatgaaaacggttatatacttacaaactctgattgttattctatcatttttattccattcgtgtagtagtgaagaagttgataaatgcgataaagaaataataacctttcttcctgctgtcagtgtatccacacgttcgactatggaacgaggatttgaagaaggagataaaattggaattttcctatttgatcagaacaaagctgcaaagtggaaatatggtagcgaatgttgggtaagtaatattcccgttgaatataaaggaagtgttggctgggattctgagatgcaactgtattggcaaaaagtcccctatacacttatggggataggatattatccctatgctagcagtacgttagataaagacttcacaaacgtttactttcagcttccgaatgatcaaagtaatcggaaattattaagacaaagtgatgtcttatgggcttctactacagatattatttatgagaagtataatggagggattcctttattattcaatcacttgctcagtaaattaactgtttcattcataaatactacttctattgcaaacagtgatatgaagaatggggtacaagtgaccaatgtctataatagagctatcgttaatctagttaccggagaagtgagctatgagtcaagtatatcaccacaggttattcaaatgtattatgacgaaaataggcaaacagctgaggctataatcattccgcaaagcgttccggtcggacagtggattaatttcaaatataaaggtcgtttttaccattatcaattgcaagagcctcttatattagaaagtggaaaggagtataagataacaatagatttatcaactgtccaataaaatgaatgatatatgaaacgcattgatttatctggcttacgtaccttagtaatgctgcttgttctagcagcttgttctacagaacacgaagaagaaagaatatactttgaaatcagtcaatctatatctaatggatttcagtcaactgatggaaaaccacaagattcaagtatttcttttaatacaggagatattatcggagtatttttaacagaacaaggtagtcagctctctactgacagctatttatataatcaagtttgtatttttgacggcaatcaatggtcactcggtaagcggttttcattccctgctgagaataaaggtcagaaaatgaggatggtagcttattatccatttatgcagccattagaaaacgctgttctgccatttgaagttgcaactctgcaaaataatgcgaataaacagaaagaaagcgatttgttatttgccgaacaggaatacattatatctgaagcagcggttgatattcatttttctcacttgatgtcacaagttacatttcaagtggattatgccaatgggatatcagatgtttgttccaatatatatctgaaagcgtgcaaccaatgttcattaaatttggaaaatggtgcggtaagtactcatggaaccgtaacgagtattgaagctatgaaattaaaagaggaaacctctgataacagttcaaggcgattttcacttttaattccgcctcagcatctttctgatgaacaagccatagaattgaaggttaatgagagtcctttttttataaaactagaccaaacttttgattctggagtacattatattatgcatcttactgttttgggagataggcaggttacattgaatggcgttagtgtagctagctgggaaagcgtcaatgtgacgcaaggcagcctttattctcccgaaacctattcgacaggagatgttatcgtatatcagaaaatgagggaaaaacatctggtaactctggttgtaacaggtgatggatttaccaccaatgaattagcgcctaatggcttgtttgaaagtagtgcacgtgaagctttaaactgtttgttctctgtagagccatataaatcatatcgtgaatatttcaatgtttatatccttcctactgtttcagaagaaactggtgcgggaaatacggatacgggaaaaatgagaaacacctattttaaaacaagttggggaaacaattactcggacatgcaagtaaaagattataatgagattttcgatttcgtgagttctacctgtccggatatcatagagaataaaacgtctattgataaagttcctgtttttcttttagttaatgattcacgctatggaggtatatgttggatatggaataacggattaagttatgctattattccgctgacagaagggaatcttcaatggtctggaaattctagtattggtataagtactggtgattggaaaaatgtttttgtacatgaaggcggaggacatggctttggtaaactattagatgaatatcattataacgatagcccaaactatacagctgagtcaatagaaagccaggcatgggaggttccccttggtctgaaccttacgacagattttaataatactaagggtagcgtctattggaagcacttgctgaatgattcccggtatccccgcacaggctttttcgaaggagggatgggctataagagtggtatctggcactctgaaattataagttgtatggatgataaccgtctatatttcaatacaatatcgcgtcagctgattgtagagagaattaaaacaatagctggtgagccatttgtaatagaagagttctttgcaaaggatataaattatgatccgttgcgagattttaattcgtttaaaacttcggatcaatatggtataagagaaaaagccaggcaggtgcctcgtacaccgcatcctcacttgatgaaatagtaactggatataatattatgggaatatccaccagaagaaaacacagaagatatgaataagtataaagtagttatagttgatgacgatgaagtggctattgggaagttgagtgatgcattgaaaaagaatccacgcttctctatagaaggaactgcgcgaaatgataagcagggaaagaaacttatagttaagatacaaccggatttgttgtttttggatgtggaaatgtcggatacagcaggtttggatttgttgcatggtctgcgcgacagtatttcatggaatatacgggtggttttctatacggcttatgaaaagtatatgatacatgctattagagaatcggtgttcgattatttgttgaaaccattcaaggaacaggaactggagtacattcttacacgctttataacacaagtagaagcggaacaaaaaaggtcattgccaataggagcatctttgtatatggggcaaacattcatagtgtttacgccgactaatgatatgcgtgccttgcatctggctgaggttgtgttttttcgttattgtgccgaacgcaagcaatgggaggtgatacttagcactcaattgccagtggtgttacggcgtggaatgactgctgaacagataatcaaatattcgcctagttttgttcagatacatcaatcatatattattaatatcgattatttgatgattataaaggataataaatgtatgctttatccgccttttgataacgtgacagagctatttgtttccaggaaatataaaaaagagttgcaagacagattttgcttgtgaaagtagaatggcgaatttgactgttaattcataaattttatccaaaagaaggaaaaagaataaaataaacaagaactaaagttacatcctatccataaaaatactatatttatcgcagctagagagcactttaagtaatgcttaagacagaaaacgaaaagtagtgtatatactatatattttctattattaattacttaaacacattttttatggaagccaaaaaatcaaaaaaggctgcaattgagaatcaaagaggttcttggttgttgatgggtttggttgttgcgcttgctttcatgttcgtatcgttcgaatggacacagcatgatgtaagagttgcggcagtatcaccagatgatgaatccatctttgtaacggagctcgttccaatcacattccctgaagagaaactggaaccgccccctccaccggaaactaaagtaacagaattgttcgaaatagtagatgataccgaagaggtgacggataacgtttcagtagtgccggacaatgtgaatgaaccttacaaggttgtttggataccgccggttgtggaaacagaagaagtggtggaagacgttattcacgtaagtgttgaagtcatgcccgaatttcccggtggtgcggcagaattgctgaaatatttgagtactcatatcaaatatccgacaatgtctcaggagatgggctcacaaggacgtgtaattgttcagtttgtcgtagacaaagacggatcgattactaatccgacagttgtacgaggggtagatgcttacctggataaagaagctatccgtgtgataagtggaatgccaaagtggaagcccggagtgcagaacggtaagaaagttcgagtaaaatatactgtacctgtagtattcagactgcagtagttacttgaaataaatgattaaaagggtcggtccaccgcgggagccggcccttttttcaataaaataatatatctttgcgtcacgaacaaaaaaaatgaaagactggtttatgaatcttctgtattacctaaaaagacctttaatctggctctcccgtttccgctaccgttgcggatatggtgtgcactctccttttgctttcagtctgatcacggacgtgatttatgagaagatgccttattatgcatacgacctgctgaaggcggaacagaaaaagcggatcacaacacagggatgggagaaaggaataccaaggatcaaccgtctgttgttccgcctggtgaataaagtgcaaccggccactatcatagaagtaggccagccctcggcagcctctttatatttacagtcagccaaaccttctgccgggtatctttttgcttctgacttatcagagctctttctggatgccgatactccggtagactttctgtatctgaatgactatcggaatccggctttgctggaagaagtttttaacatctgttcccgtcggactactccgaatagtttgtttgtcgttcatgggatctgctattcaaaggcaatgaaaaatctttggaaacagttacagaatgatgagcgggtgggaatcacttttgacttgtatgatgcaggcttgcttttttttgatacaacaaagattaaacagcattatatcgtcaacttctgatcacctttatacgttaatcttatatatagtaatgatgaaaaatagacgtttatgaaaaaaagccttgtatatacaaagaccggtgacaaaggaactaccagtcttgttggcggaagccgcgttccgaagacccatattcgtttggaagcatacggaacaattgacgaacttaattcccatctgggatggctgaatacgtatttgctggatgaggcagaccgggattttatcctgagtatacagcataagctattctctatcggttcacatctggcaactgaccaggaaaaaacacaactgaaagccgccagtatccttacttcggaggatgtggaacgcatcgagcgcgagattgataaactggatgaacaactgcccgaactttgtgcctttatcatacccggaggtagccgtggagcggctatttgccatgtgtgccgtacgatttgtcgaagagccgaacgtcgcattctgactctgtccgaaacttgtacaatttctcccgaagtgttagcttttgtcaacagattatcagattatttgtttgttttatcccgaaaaattaattttgatgaacaaaatagtgaaatattctgggataatagttggaaatgatagattttattatacttttgccgaaaaatagaaaataagtattcactttttaatactcaagattatgtattggacattggaattagcatcgaaactggaagatgctccctggccggcgaccaaggacgaattgattgattacgctatgcgttcgggtgctcctcttgaagtgatagagaatctgcaagagatggaagatgaaggcgaaatctatgagagtatcgaagatatttggccggattatcctagtaaagaagatttcttttttaacgaggaagagtattgatttagaaaaagaaaccgaacatataaaaatacccgatagctgtgtgaaagctatcgggtattttttattctcatacaatattaaaagaccggcatctgccagatgaatcctaccgaaatccggttggtactgtaattctcttgtcccagcactttggcacgggaggtgaagtcataagaacgtcctacataggtcacgaagaaatgcaggttggtttccatcggataaaattcgatacctgccagatacccccaggaggtacggtagttacctttttctatcccttcggaggctttggttacggaagccgtttcatacattcctttcacgaaggcattccatttcgggaggaaacggtagttacacttggctactacggataaataacctgtatcaaacgcattgtgtccgcccgggcgaccgacgatgccggtgataatccctttacggtcaatctcttcttttgagtacatgaagtcgacaaaggcgttccactttccgagattcagttcatttcctacagcatagtaatacatattatgatctttggcttcgttcatcacagaggccgaccagcgggttttaaatacattattaaaattgccaatccagtttaaggtatagaccagcggcatttttccggatttcagatcggggagattaccctccgcatcctctgtgattccgtaagtgttgtcgaaagagctattgcggctgttcaatatctgcagattaagttgctgatcgggagtaatgttataacttgcattcagaccggtcaggaagttactcatgtaatcgatcatatcacaatattgatagacatcgatcgggttgaggtcaaactcgaagccgccatagttggcactttgtttaccggcaaacaggttgaacttatcgttgagcttgatgccgatgcctgcccagtcgatggaggtcgggaggttgtctatcatattgtttccgtcgttcgagcggttgagacgctggcggtaacgataagaaagccagttgttgatatttcctttcgcttcgatgcggagctggtgcatattgaagtcaccttcctgaaatccattttggaaatgagcgtcaaaacttccttgcatattcaggtataagttgaacttatccgttttcttttttacgtctgtaagttcctcgaaaagaggagtgtttggggagaacttttgggcatacattgcctgtatgctacccgcaaggagtagcataaacattaattttttcataagtaggtccggtttttagtattcgttaaagtattcctgaatttgtttccagtccgtggttttggtcagcgcaagcatcaatagtacacgtgacttttgtggattcaattcttgagaggctacaaactgatacttggcgtcatccacttccgcatcaagagtggtaggaccagtcggtacgcgggaagaacgaacgactacaatgccttttctgcgggcgtctatcaatgacggaaatatgtttttatggatattaccgtttccgactcctgcatgaatgattcctttatatccgttgttgagcaacggagtcatcatatcggcttcaatattggaatagctgtatacgatgccgactttgggcaatgaagtcagtttggtgacatcaaatatggattgggtggtatgtttcttcagtgtgatctgattataacatactttaccgttcagtacatatcccaatgcgccggagttgggagcctggaaagtctgtacatcgaccgtgttcattttaactacgctttctgcacctagaatcagaccgttcatggcaaccagtacacctttgtcttttgaatctttagctgcagcggtaactactgcattataaagattcagcggaccgtcggcacttaatgctgtagaggggcgcatggcacctaccaatacaacaggcttgtcacttttgacagtcagatttagaaagtaagcagtttcttccatcgtatccgttccatgagtgatcacgattccgtcgatatccggtcgtttcaataactcgttgattttcttggcaagtgtcagccagacttcgtcattcatgtcctgtgaaccgattctcacaatctgttcgccggttacattggcgatatctttgatttcggggactgcatccagcaatgcaccgatagcaacttgtcctgccgtatagctggtgcccgtagccgagcttcctgttccggcaatggttcctccggtagcaaggatgtggatattcggttttgcggcaaatgccattgttgcggataatagtagtgttactactaccaggcctaatttcttaatttgtttcataactgaaatgagtttaggttaataatatattagaatatttgaataaagagcagtcctaaaacaatagcgactacggtagataccagtccgggcatcataaacgaatgattcaacacatatttaccgatttttgttgtcccggtgcggtcgaaattaatggcggctacgacagtcgggtaattcgggataaagaaatatccgttcactgcggggaataaggcaatcagcatatacggagaaatacctaacgcgatgcccagcggcatcaatgcccgcaccgtggccgcctggctatacaacaggatagacatgacgaacagcgcaataccgaacagccatggcatctgccgcacgattccttcgatggaaagagtgagctgtgccatattgccctgaaggaaagtatcacccatccacgcaataccgaagatggcgataacagcctgcatcccggcagggaatacagaaccctgcgttgctttgattccatccgtcttggttactataaggatgatagcggctgccgacaacattacgatctcgataatggaggacataccgagcgtgacgatttctccatcgatcaggaaactgggacgcataccttcaaaagatccgaaaaggacgataaaagcagttgccaatataaagatgagtacggaaagcatggcggaacgtttgttcttgacatctttaatctctatcttcttgtcattgaaaagaccttctttcaagcgtttctgatattcgggatcctctatcagttccttgccgactttcatggagaataaagcgccgaccaatactccgatgatagtggcaggaatcgtaattttaagaatatcgaataatgtaatgtcgaaacctgccagtaacccgagcaaagctaccgttgcagcagagatgggactggctgtaatagcctgttgcgaagcaatcacagcaatacccagcggacgttccggacgaatctttgtttcggtagctacctcagcaatcacgggcaatacggaataagctacatgcccggttccggcaataaaggtgaacagataagtcaccaatgggctgagcaacgtgacgtgcgaaggatttttgcgtagcaaatgttctgccagtttcaccatatagtccagcccgccggctgcttgcatacaggaggcagcggaaataacggcggcaatcatcaacataacgtcgataggtggtgcggtgggttgtaaaccaaaaacaaacgtgagtattcccaatcctactcctcccatgacaccgagtccgatgcctcccaaacgtgcgccaataataatggctgtcagaacaaatgctaattgtaatatcattggttgttgttttataagttcctaacaaagataaaggatttatcttcgttttttctctgtttctaagataaacaacaaaaaagttattgaatagtttttgcatatttattaaaacaataacatctctgactggttattatatcaactaacgaatgtgttattgttataaaacaaccgatatggaacagaaattatcaaaaaaaactcgtacagagagcgacttgataggtagtcgtgaagtgccggaaagtgcattgtatggagtacagacactccgtggtattgaaaactttcgcatcagcaagtttcatttgaatgagtatcccctgtttattcaggcattggccatcacgaaaatgggagctgccgttgccaaccgtgaactggagttactgaccaagaaacagacggatgccatactgaaggcttgtaaagaaatactggaaggaaaacatcatgaccagttccctgtagatatgattcagggaggagctggaaccaccaccaacatgaatgccaatgaagtgattgccaaccgtgcactggaactgatgggacatgcacgcggagagtatcaatactgctcgcccaacgatcacgtcaaccgttcgcaatctaccaatgatgcgtatcctacagccattcacattggtctgtattatacccatcttaaattggtgaaacactttggaacactgattgaggctttccgaaagaaaggagcagagtttgcacacattatcaagatgggacgtacccaactggaagatgccgtaccgatgacacttggacaaacctttaatggatttgccagcattctggaacacgaactgaagaatctggattttgccgcacaggattttctgacggtcaacatgggggcgacagccatcggaaccggaattaccgccgaaccggaatatgcggaaaagtgcattgctgccctgcgcaagattaccggactggatatcaaactggcagatgacctgataggcgctacttcggatacttcctgcatggtaggatattcttcggccatgcggcgtgtatctgtcaagatgaacaagatctgtaatgatctgaggctattggcttccggtcctcgttgcggactgggagaaatcaatctgcctgccatgcagccggggtcttccattatgccgggaaaggtgaaccctgttattcccgaagtcatgaatcaggtttcttataaagtgataggaaacgacctttgtgtagctatgagtggagaggctgcacagatggaactgaatgcgatggaacctgtcatggcacaatgctgttttgaatctgcggatttgttgatgaacggttttgatacattgcgtaccttatgtattgatggcatcacagccaatgaagaaaaatgccgtcgggatgtacacaacagtatcggagtagtgaccgcactgaatcccgtaattggctataaacattctacaaagatagcgaaggaggctctggaaacgggtaaaggagtgtatgagctggtgctggaacataacattctttccaaagaagacctggatacgatcttgaaaccggaaaatatgattaaaccggtgaaactggatattcatccgaatcattgattcataggggtaaaatgagaggccagcctgttgatataggctggtctctgtgttttgtatcattagtgtattttatgtatttaatcttggattctttttcatttactcgtaaaaaaaacgaaataaataaaggaaataaattgataatgtctgttttttagtatattcgtaaaaagtagtgtacatacaaagcaaaactaaaagaatacaaattaaaaacagcgattatgaaaaacagaccttttgagaattttgactttacagacttctgggatgatgatgaatatgctatgaatgaatatattggcgcgcctccaacagaagagatgatagaagaaacagaacgtgaactgggatacaaactccccgaatcttatatttggctgatgaagcagcataacggtggaatacctttcaatgtttgttttccttgcgacgagcctaccagttgggcggacgatcatgtggctatcaccggcattatgggagtcgataaggataagatttattctctttgcggacagctcggcagccgtttcatgattgaagaatgggggtatccggacattggagtggctatctgcgactgtccttctgcgggacatgatatgattttccttgattatcgggagtgtggtccgcagggcgaaccgaaagtcgttcatgtcgatcaagaagatgattattatgttactttccttgccgataactttgaagaatttattcggggacttgtcaacgaagaagtctttgatacgtcggaagaagatgaaagaatggagctggaaaaagttcggaacgcagctttctcaccgctcttgtccgatttgtgcgcaaagtgtgatcatcccgtggatacggagcgatggattcggaagatatcggaagagatagtaaccgataaaggattctttgcgcttcatgccgacgaacgttcttatctgctttacgacatccagttgtggctttacaccaacgtttatcccgatacgacggaagaagattacctgtctgcttataaaaagataatagcgctggacggtgagttcagtacgggaggatatgcttcggactttgttaccgattggctgacacgacgcaaggagagcggtatggttacgtgtaatgacggtattctttcgatggcagcgggaactaaggaggccttgctggcaaatcgggagttgatttcgaacaaagagcaataatttgtgtttatttattataaatatatatctttgtcccgaattataaacacgtagatttatgaaaaagatttttggtgctttaatgattgccgtatgtatcggtatggcgatgcctgcccaggcacaattacattttggtgtaaagggtggtttaaacttgtctaaagcaagcttttctgatgtgaaagaaaactttaaaaaggataattttacaggtttctttatcggtccgatggcggaattcaatattccggttgtgggattaggagtcgatgcgtctttgctttttgctcaaagaggtataaaaatctctgatggaggtgaagaagctactgtcaagcagaatggcttggatattccggtcaatttgaaatataacatcggtctgggaagtctggtaggtctttatgtggctgccggtcctgatttttactttgattttgccggtaataagacaatagacggagtaaaaaccgataaaaagaaagctgaagtcggtatcaatgtcggtgcaggtgtgaagttgctgaatcatctgcaagtaggagctaattataatattccgttgggcaagactgccagctttgaagacattgaaggctcatacaaaaccaagacttggcaagtatccgttgcttatattttctaagccatccgttacattcaatcatacaaagaaagagcttccgataaaggaggctctttttttattcaaggtattttgtttaaggtactggtctgtaaacctgaatctattttatcagattccggtgtgcagactatttttcttatcagtgttccctcttcctcttttaaatccccatttttttattgtacttttgtgcttgcaatgaaaaagtatgtagatgtcatattaccattaccgcttccgaagtactttacctattccctgccggatgaatgtgcggaagaggttgagattggatgccgtgtgatagttcctttcggacggaagaaattttatacagctatcgttcgtaatgttcattattgtgctccgacggagtatgaggtgaaggatatatctgcattgctggatgcttctcctattttattgtccactcaatttaagttttgggagtggctggcggattactatctctgtacacaaggagacgtttataaagcggcacttccttctggtttgaagttggagagtgaaacgattgtagaatataatcccgattttgaggcggatgcaccattatcggaaagagagcagcgtattcttgatttgctttcagtagattctcagcaatgtgtcacgaaactggagaaggagagtggcatgaaaaatatcctcacagtcatcaaatctctgctggataaagaagccatctttgtgaaagaggaattgcgccgtacttacaagccgaaaacagaggcgagagtacgattagccggttctgctgatgaaaagcggcttcatatcttatttgatatcctgtcccgtgctccgaagcagttggcgttgctgatgaaatatgtcgagtgttcgggaatccttggaagagaaacaccgaaagaagtttcgaaaaaagagctgttgcaacgtgcaggggtgtctccttctattctgaatggcttggtggagaaaaagatatttgagatttactttcatgaagtcggccggctgaatcaggaaatgaaggaggtcgtagagttgaatgccttgaacgagtttcagcagcgggcgcacgatgagatcgtgcaatcctttcaggaaaaaaatgtctgcctgcttcatggagttacatccagtggaaagacagaagtatacattcatctgatagaagaaacgattcgtcaagggaaacaagtattgtatctcttgcctgaaatagcattaaccactcaaatcacagagcgcctgcaacgggtattcggttctcgtttggggatttatcattccaagtttccggatgccgagagggtagagatatggcggaagcaactgggagataaaggatatgatatcatccttggagtccgttcttccgtatttcttcctttccgtgatctgggcctggtgattgtagatgaagagcatgagaacacctataagcaacaggaccctgctcctcgctatcatgcacggaatgcggctattgtactggctgccatgtatggagcaaaaacgcttctcggcactgctaccccctccatagaaacatggcagaacgcaaggaatggaaaatatggatttgtacaactgaaagaacgatataaagaaattcagctgccggagattattccggtggatatcaaagaactgcatcgcaagaggcggatggtcggacagttctcgccgttactgatacaatatatgaaagaagcactggaacagaaagaacaagtcattctcttccagaaccgtcgcggatttgcaccgatgatagaatgccgtacttgcggctgggtaccgaaatgtaagaactgcgatgtgagtctgacttatcataaaggtatcaaccaactgacctgccattattgcggctatacctatcaactgccgaagttctgtcccgcctgtgaaggaacagaactggtcaatcgtggctttggtacggaaaagattgaagatgacatcaaagtccttttcccggaagcggctgttgcccgaatggatttagacactacccgtacccgcgctgcctacgagaagattatcgccgattttgagcagggaaagacggacatactgatcggtacgcaaatggtatcgaaaggtctggactttgaccacgtaagtatagtgggcatcttgaacgcggacaccatgctcaattatccggatttccgttcttacgaacgtgctttccaactgatggcacaagtagcaggacgagccgggcgtaaaaataaacgcgggcgggtggtactgcaaacgaaaagcattgatcaccccattatccatcaggttatcggtaataactatgaagaaatggtagacggtcaactcgctgaacgacaaatgtttcattatcccccttactatcggttggtgtatgtctatctgaaaaaccataatgaagcattgctggaccagatggctgcggtcatggcagagaaactaagaactgtgttcggaaaccgggtattggggccggacaaacctcccgttgctcgtatccagacattattcatcaaaaagatagtgctgaagatcgaacagaatgccccgatgggacgtgcgcgggaattgctacaacgtatccagaaagagatgttggaggatgaacgctataaatccttgattgtctattatgatgtagaccccatgtagcactcgatacagacctaatatttttcttataataacctttataaattaactaaccatgaaacgacttacgatttattgcttaacatgtcttattggtgtgagtcctctttttgcccagcaaggagtgactcagtgtggaacccctacggggcaaccgaaatttccaatagaaacttatcaggaactgcccgacccttcctccccctctgataaagactgggcagcagttaccaaccctcagatttcctggggaactattgacacccgctatgcgaagcatcggcttcctcagctgaaaaaacagcagcttaccactttaaaaggctggcgtggcgaacgtataaatgcgcaggctgttgtctggaccggcactgaggtgaaagatctgaacttcagctttaccgattttaaagataaaaaaggaaatagcctttcggatgaggcgtttaaagccggtttcatccgttatgtaatgaccgatgaactgaataaagatggcagaggcgcatgcggtcaccgtcaagcagtggattacgattcgttgttggtagccgacccgattgatacgaacttgaaatcaatgtctgttccggcacgtactgttcaacctatctgggtgcaatgctggattcctcaatcggctactcccggaacctacaagggtgccttgctgataaaagacggttcccgtctgttgcagcagcttaatctcgaaatccttgtttcttcccgtgaacttcctgcaccgtccgaatgggcttatcatctggatttgtggcagagcccgtttgccgtagcccgttattatcaggttcccttgtggagtcaggagcatctggatgctatgcgcccgctgatgaaaatgctggcggatgccggtcaaaagattatcacagccactttgacacataaaccttggaacggtcagactgaagattatttcgagacaatggtaacatggatgaaacgtgccgacggcacttgggcttttgactatacggtttttgatcgctgggtagagtttatgatgagtgtcggtatcaatcagcagattaactgttactctatggttccctgggaattatctttccagtattttgatcaggcaacaaattcattgaaatttgtgaggacagcaccgggagaacctgcttatgaagaaatgtgggttgcgatgcttacttctttttccaagcatctgagagaaaagggatggtttgatatttgtgcaattgcgatggacgagcgtccgatggatgtcatgcagaaaacgttgaaagtaatccgcaaggcagatccggagtttaaagtttcactggccggtaattatcatgctgagatagagccggacttgtacgattattgcattgttatcggacagaacttcccggaagaagtacgtctccgccgtgcggccgagaataaacgtaccacctattatacttgttgtacggaagcacatcccaatacattcactttctccgatcctgctgaggctgcatggatgagtttctattcttcgaagaagcatctggacggctatctgcgttgggcatacaatagctggcctttggagccgttgctcgattcacgtttccgcacgtgggcggctggagatacttatcttgtgtatccgggagcccgtagctgtatccgtttcgaacgtctgatcgaaggtattcaggcacatgagaaaataacgattcttcgtcaggaatttgagaagaagggaaataaagccggattaaagaagatagagaaaatgctggccccgttcaatttgggtaatatgccggaaataccagcagccgttaccgtaaaccgggccaatcagatacttcattcgttttgataatagaaacgaatgaagcctgtcaattattaaacgtaaattatgaagaaaatattatttgtctgcctcggaaatatctgccgtagctctacggcggaaggagtaatgcttcacctgatcaaagaagccggactggaaaaagaatttgtgattgattccgccggaatcctgtcttatcatcaaggcgaattgccggatagccggatgcgtgcacacgctgcccgtcggggctatcaactggttcatcgctcccgtccggtgcggacagaggacttttataattttgatttgattattggcatggacgaccgtaacatagatgatctgaaagaaaaagctccttctacggaagagtggaaaaagattcatcgtatgacggagtactgtacccgcattcccgccgaccatgtccccgacccctactatggaggggccgaaggatttgaatatgtgctggatgtactcgaagacgcttgcgctggtctgcttacttctttaactcaggataactgatccgtgtgtgataagcgatcttcagtttttctttgaataccgtcttgatggtcgcaatgtccttgaaagtgatagggcattctttgaaataaccttcagcaacttgggagtctataattttgtcgaccaggttgctgatagtttcttccgtatattccggcagactgcgtgacgccgcttcgacagcatccgccatcatcagaatagctgtctcctttgagaaaggattagggcccggataggtgaacagttcttcattcggttcctcgtcggggtgctcgttcttccatgagatatagaagaacttcgtttttccccgtccatgatgggtgctgataaagtctttgattactttcggcagattatgcttgtccgccagttttaatccgtctgtcacatgactgatcacgacctgggcactttgctcgtaattcagattcttatgaggattgacgcctcccgactgattttccgtaaagaaagcgggattctccatcttgccgatatcatgatacaaagctccggtacgtactaattgacttttcgctccgatacggatcgctgcctctgccgccagattggctacctgcatagagtgctggaaagttccgggcacggtttcggacatctgccggagaagatcactgttgatattggaaagttcgaccaaagtcacattagaggtaaagccgaacgtcttttccagcagaaacagcaacggatatgtaaacagcagcagaataccattaataaagaaataggtatacatccgtgcattcagcttagagaagtcattggcaagtccattctcggtcattagctcgaatgcgaagtaaatagccgcataagtcagtatcaccaataaggccgtgcggaagagctgtgatctctgcgaaagttcccttaaactgaaaatggcaactaatccggcagccaactgcgtcagaatgaactcatgcggaaaacgcagggatatagagcagattaatatcgtaatgacatgtgtcagaaaggcagttcgtgaatcgaggaaaacccgtatgataatgggcagcatcgcgtacggaatcatatatacattaaatatattatgtgataccatgaaagctgttactacactataaaatacaatcagtgtaaacagtaacgacaggctgcctttgcgctcataataatcttttcggaacaggtcgagatagagcataaagcaaagcatcagcataccgacaaacaaaatctgtccgccaagaatcaagcggctctgatcaatggattcacttcgcttgatagactctttgcgtaatgattccagaatattgtacgtttcggggctgatgatttctccacggtctataattttctgtccgctgacgactaatccgttggcccaggaatagttgttcagcatttcctctttggcggtctgtgtccgttgctggtcgaatgtgagattgggcgtgatatattcgtttaaagaacattgtctcagaatctcacggttgaagtgggtcgtatctgcggaaagcaagtactcataagcttttttgaccgtatatatatgatcggtaggcttggagttggcgagtttatcgtcgatgatcatgattgccgaagtactgtccttgtggagttcttgtatgttttctgtcgaaacgatgccctctccgtatatttcttttaatgtccgttcgatgtatcgcagataatctacggaaggaagtatacctttcaggtgagtatggtaattctctttcagcttggcgattgcgtctttctctacttgtttgtcaagcagataatatggttggaaggaagccagcaaactatcctgttcccggttcaccactgcgtcgtctttatagatcggaaagtcaaaagtggctatcagctgcccgtacttccagggcttgtttatgtcaaactgatagttgaattttccgtcacgtggcaggaaatagacaatcagtgtcactgtcgctacaaacagcaatgatttatataatatatctcttcttgagaacctctttttcttcttcatatgttccatacgcattgaaatttttgcgaaaagtacaaaaaaaaacaatagtgtggaaaaaaaggtttaattttgccacgatttacctatactaacccaaattatggcagaaagaaaagtaagagttcgttttgctccgagtcctacgggagcattgcacatcggtggtgtgcgtacagctttgtataattatctatttgcgcgtcaacacggcggagacctcattttccgtattgaagatactgactccaaccggttcgtgccgggagcggaagagtatatacttgagtcattcaagtggttgggtatccactttgacgaaggagtgagcttcggtggagaacacggcccgtaccgtcagtccgaacgtcgcgaaatctataagaaatacgtgcagattttgttggataatgacaaggcatacatcgcttttgatactcccgaggaactggacgctaagcgtgcggaaattgctaacttccaatatgatgcatcgacccgcgggatgatgcgtaattctctgacaatgtcgaaagaagaagtggacgcattgattgctgaaggaaagcaatatgtggttcgctttaagatcgagccgaacgaggatgttcacgtgaatgacttgattcgtggcgaagtcgttattaattcatctattctggatgacaaggtgctttataagtcggctgacgaactgcctacttatcatctcgcaaacattgtggatgaccatttgatggaagtgtctcatgtaatccgtggcgaagaatggttgccttcggcaccgctgcacgtacttttgtaccgtgcattcggctgggaagacacgatgccggaatttgcccacttgcctttgctgttgaagccggaaggaaacggtaaactaagcaagcgtgacggcgaccgtttgggattccctgtattcccgttggaatggcgtccggaatcgggagaagtgtcttccggatatcgtgaatcgggttatttgcccgaagcggtgattaacttcctggctttgttgggatggaatccgggcaacgatcaggaagtgatgtctatggacgagatgataaaactgttcgacattcatcgttgcagcaagtccggagctaaattcgactataaaaaaggtatttggttcaatcatcagtatatccagcttaaaccgaatgaagaaattgccgaactgtttttgcctgtgttgaaagagcatggggtagaggctcctttcgagaaggtcgttacggtagtcggcatgatgaaagaccgtgtaagttttatcaaggaactgtgggatgtatgtagtttcttctttgtggctcctgctgaatatgacgaaaagacagtgaagaaacgctggaaagaagactcggcaaaatgtatgactgagttggcggaagtaattgccggcatcgaggatttcagcattgaaggtcaggagaaagtagtgatggactggattgctgaaaaaggttaccatacaggtaatataatgaatgctttccgtctgacactggtaggcgaaggtaaaggtccgcatatgttcgatatttcctgggtgttgggcaaggaagagacattggctcgtatgaagcgcgccgtagaggtacttaaataattaggatttgtaaattatgctttacaatctggcaatagttatttatgaccttttggttcattttgctgctccgttcagccgtaagccccgaaaaatgatgaaagggcattgggtggtgtatgaacttctacgacagcaagtggagaaaggggagcagtatatttggtttcacgctgcttcgcttggcgagtttgaacaagggcgtccattaatagaaatgatcagggaaaaatatcccgattataagatattgcttacatttttctctccgtccggttacgaagtgcgcaagcattaccggggagcggacattgtctgctatctgccgtttgataaaccgcggaatgtgaagaagttcctggatattgcaaacccgtgcatggcattctttatcaagtacgaattttggaagaattacctggatgagcttcataagcgtcgcatcccggtgtatagtgtttcttccattttccgtcgcgatcagatattctttaaatggtatggtgggacttatcgtaatgtgctgaaggatttcgatcatttgtttgtgcagaatgaggcttccaaacgctatttgtcgaagattggcatttgtcgtgtgacagtggtgggagatacccgtttcgaccgtgtgttgcagattcgggaagaggccaaagaccttccgttggtgaaaatgtttaaaggagacaatgcctttacgtttgtggcaggcagttcttggggaccggatgaagatttattcctggagtacttcaacacccatccggaaatgaagttgatcatcgctccgcatgtgattgatgaaaatcatctggtggagattatcagtaaactgaaacgtccttatgtacgctatactcgtgctgacgaaaagaatgtactgaaagttgattgcttgattatcgattgcttcggactgttatcttctatttaccgctatggagaagtggcttatatcggaggtggttttggcgtcggtattcataatacgctggaagctgctgtatatggcatccctgttatcttcggaccgaaatatcagaagtttatggaagcaatccggttgctcgaagctaaaggcgcatactcaattaaagactatcacgagttgaaaaccttgctggaccgttttcaggcagatgatgttttcatgcgtgagaccggtgcgaatgctggttattatgtgaccagtaatgccggagctacggagaagattatgcacatgattaacttttagagatggataaggttgggcgtcgcctgaaaaacaggtaagccctatcatttcgctctgctgttctgagcttgtcgtctcgtttttcttaaagaagagagattcgtcaatgaactcagaatataacagaataagataagaataaggagatgtgtcagaactccccttttaacgaattcatcttcgccacaactatctgtagcgaagatgatttttaatttataagggtttcgatacacccgcttaccagtacatcttttgaaaatgctggtattctatttatttatttcctgttttaataactcttccagttcttttcgtgtcacatgggtgaatcgtttcactatatttccttgcttgtctatcaccaaatacatgggcaaacctttcatctgaaaatgtttccaaagataaccccattgcttttcgtttaaccaataatgttcaccgacaatgtcttgtatgagtattttccaagtcttttcgatggaactggggccagttaggtagacaaaagctacgttttcgcctaattcttttttaataggttcatattctttaatcgtccttcggcagccaccgcaccaggtagcccaaaagtcaatgaattgtacttttcctttatggcggtcgacgagagcagacagtaattcttcttctgatactttaggtgcttcgcagacagagtatttctttgttgtcacttttgcgcgtggttgcatctgtcggttcatgtcttgaatgattcctaagaaaatcgggtttgtaatttccgttgccatagcttcttgttgagtggtcagtggttttaaattatataggctggagcgcatatagattgcccgtatataatcgaccattaaacaagtgctgtcttgcatgatatggctcagatactccttcgctttggtgaatagtttctgactgaattcattatattctttggggtattttgcaataagcgcgatcagctcgctgccttgttggaaggggatacctgttttgagagctgtctcgtattggcgaataagcgcttgttcctcctttgtaagcgctgcttttgatagtaaatacttctcaaattttaaaggatcatgatgtagctcatagagttctcctgagatcacgttgcggtaattgtaacaatagagcgctaagggatgattgacagggaaactctttaggaaatcatagaaattggcaggaaaatcaaaattggcaaaggctgtactggcttgttcacgcgtgatgttttccttcttctgataagccgtttgcagacaataacgggttgcattcagattctctatgcaatcgaacgcacatgagagattggcaagtgtgcgggtatcttcactaaattgcgtttttgtgttgttgtgtgccacgcactgtttgtattggtcgatgcagcgtttcttaaattcattggcgctgatgcctgcaatagaatccagtatgtcgccatttctataaaccggagctattcttgtaatcaattctggctggcaccattcattattgatggtagcatattgtccgctgaatacaaattgttttccttgcggattgcttagattgaccgctacattagtttctttatcgggacttagcagaatgactatatcggctttccctatcgtcatccgtacttgtgtgttatgatagagaggaatattgattttgaagcttccgtctgcttcgatagtcgggaagagggtttcggctgcccccatcacaatattaggagctccgattttgaggtccggatgatcatcagggctataattagctattgtgccgcttagtatggcttttcctttttgatattcgggactccgtaattgtgcttgtactatgttgaatagcagggacaagaaaaggaaggtaaacagtctgttcataatagttctttgattgcatttataatttctttatctgtattctctgtgctatatcctctgattatttttcgtatgattcgtttctggtccagtatgaaaaagaagggcgcagccccacctgtctggtattgtttgataacttcgttcgtggcatttagaatcgtataattcaaatctttccgtttggcgtagtttcggatggcggatgcattgtggctccaggattctatagcaatgagatcaaactcctcgttgctgaataactcttttaactttttcagaaaaggtacagctgcctggcaggcgccacagccaatgccggtgaaattgattagtatgactttgcttttgcagttggcaagtgataaagactgtccatctatattttctaatatccatcccggagctttttggcctgtgagtccggatgtggatggcgagtctccgcttttcttgtggagatcgctgtatttaactgtttcataatctttggggaaataatcattgatgttaaagtctctgatgttgagcttgttaatctgaaggttggaacaagttgaaacggaaatatcatgtgacatttcccttcgctccttaaaaggtaaattatccgatttattaatccataattcataaatagaagtcgtattgccgatatcgaatgggggaagaggcatgtggaaggcttttccaaagaattcaacctgttgttcctcattgattgttagtttgaaatagtaatcattaccctcgtctttcagttctatggtgatattatcatcagtggtaagcgcatacttgatgatgttctttgcgaaattgaagaatggaggtcttactagcctgaaagggagtggtttgaatgtgaagtcatcaattactaactttttattatcgtgataggcttctactcttacgttaccatcataacaaaagtttagctttgtagtatccttggcatccagtgaaacatagcttgcgccgatggttgaatctatggggtgattatattctttgatgaatccatgtagaatggataatgcggtggagtccccgggttgccagctttcgttagcaacataatatgttgcggattcaattttctctagattggcaaataccttttttaaatagtctctctctctgttttgagcattgactgccggcattgttgcaaaaaggagagtaataagcagtagttttgttttcatgattgatcgtggagtagtatgttttctatagttagatgtttttattctgtttgattacaaatctacgaataattcgtaaattagaggcaggcaattggttaaataaaacaaatgaatacatgaactccttcatggatattagctgatccaatacgctcctttgctaatttttcaaagatcagagatgcattgaatatagtaccctgaaaacacatgaacttactaatgatctggaacctgatatttatattattcatgtgaatcagtagttgaatgttgttcatttctttgcggttttgaactaaatgatagtcaatagtatcttaaatgggctgtctaaaaagtcaatagtatcttaactctcctccttctggaaggaggagtacccgtagggggaggtggtaggtgaatacataatcctatcatttacaaagaaataggaacaaacattatctctcctaccacctcggtcttcgaccactcctccttcccgaaggaggagattcgagatagaatcgactttttagtcacccccaatggagatactactgtttgattcattcctttgcaattttgaatcaactactgattcacattatttataccattgggaatacatcaggtaattgtgagcgattttttggtttagctcctttgcttgctccgggtctaccttcttaataaatttagccggtacccctccccaaatgcttccgggctcgatcactgtattgctcaataccaaagaaccggcggcaacgatggagccttcgcctactacggcatgatccaatatggtagaccccatcccgataagtgcataatctttgacggttgctccgtgaatcgtcacattatgtcctacggaaacatgatcaccaatttcgatggttgacttctcatataaagtatgtagcacgcttccatcctgaatattgactccattgcctatccgtatggaattaacgtcaccgcgcaatacggtacaaaaccagatgctacagtcatttcctatttttacatctcctatgatagttgcattgtctgcgagaaaacagttctctccaatttcgggggtaaagccccgcactgatttgattaaagccataaaatatattgtttctaatgatgtttttattgaatatgattggggattgtctgacacccgggtctcgtaccgtctgacacccgggtctcaagcagcctgacacccgggtgtcggtatgctcaacacccgggtgtcagacaaaagctgttttaaatagcttttgttgcttctagcagccacttcttttcttcttcgtttagacttggagaaagtttttcgtaaacggttcgatggtagtcattgaaccacttgacttcctctgccgtcagcatttctttgatgatgccttttttgcagatcgggcatagggtgatcgtctcaaatttgaaatattctccgaacatgccttccttatctttgcagaccaatgtcagattctcggtgcgtatcccgtggctgcctgctttataaacaccaggttcattggatgtaaccataccgggttgcagcacaatgggattttcgttcatacggatactttgcggaccttcgtgtacgctcagaaaatgtcctacgccatgtccggtaccatgaaggaagttcatgccatgactccagataggcatacgggccaatacatcgagttgggcgccgcgggttccggctggaaatttagccattgccaatgcaatatggccttttaatattaaggtatagtctgttttttcttcctccgtcagttcgcctaatgcaatagtacgtgtgatgtcagttgttccgtccagatactgtgctcccgaatctaacagcaagaaacctttaggctgaagcgtgacatcactctcctccgttgcggaatagtgcacgattgctccatgttctttatatccggtgattgtgtcgaaactttctcccatatacaaaggttgggctgctctgaactcatgcagcttccggtctacgctcagttcggtctctttgcccgaaggcactgattgttccagccatttaaggaacctgacaagcgccacgccatcccgctgcattgcgtgatggatgccgacgatctcctgctcattgcgaatggctttcagcaatgtcacaggagattctccacgaatgatcttgcatgcaggattgatagccgaataaatcgcatagttcgttttctttgggtcgataagtatgttttctcctgcaaaagaattcaggaaagattcagcttcatcatattttctcaggctgacttgctgttcttgcaagtattcatttacctgttgggtaatcttctccggcgaaataaagtagactacttcatcttgagtaaccagtagataacttactataaccggattgcaatgcacatcacttcctctcagattgagagtccatgctatttcgtccagactggataaaaataaagcatagatgcctttctttttcagctcggcacgaatggcggcaactttttctccacaactttttcctgcatatttaacatcgtagatgaaagccggagcatcaggcatggatggacggtccttccagatgtttttcagcggatcgccaaacaggttgacctgtaactggtagggggcaagatcttctttcatttgttccacctgttgtacggagaacattttcccatcaatactcacagattctcccggctttagattctgacagaggaactttgtgatactaggagtttccggcagcatctctttatataatgtaatgccgctgccttccagttccttttccgcttgcaggaaataacgggaatctgtccatagtccggctttatccattaagatgacgactgttccggcggaacccgtgaaaccggaaatccattcacgggacatccaataaggagctacatactcactcaggtgaggatcggtgctgggaatgatgaacgctttgatattgttagggcggaatgccatccgtagtgcgtgtatacgctcttttatgctctgcttcataccttattatattatttatagacatatttaagagtttcaaaggtactaacttttcgcggttaatgatttgtttatgaatagtttttgagaaatatttgccgaaagttttgtgaataaagaaagtatgtgtaattttgcggcgcaatttgactgcggaaatttttaaccaataacatattaataataacaaaatgattgtagtacctgtaaaagaaggcgaaaacattgaaaaagcgctgaagaagtttaaaagaaaatttgagaaaactggcatcgtgaaagaattaagaagcagacagcaatttgataaaccgtctgtaactaaaagacttaagaaagaacgtgcagtttatgtacaacaacttcagcaagtagaagattaataattcgtaatttcctttgaattattgaattcttttcatacattcgttgcacgattttagatgtagcgatattatgttaattaaatcttttcttgattacctccggtatgagcggaactattccgaaaaaaccgttctggcgtatggcgaggatataaagcaactacaggagtttgctcaggaagagtacggaaagtttgatccgttggaagtggaaggtgaactgattcgtgaatggattgtttcattaatggataggggatatacttcaacttctgtaaatcgaaagctaagttcgctccggtcgttctataagtatcttttaaggcaaggagaggtgacagtagatccgttacgaaaaataacaggacctaaaaataagaagccgttacctgcttttctgaaagaaagcgaaatggacaagttgctggatgatacggattttggcgaaggatttaaaggttgtcgtgatcggttgattattggagtgttttatgctacaggcataagactttcggaattgataggtctggatgataaggatgtagatttttccgcttctcttttgaaagtaaccgggaaaagaaacaagcagcggctaataccgttcggtgatgaactgaaagagttgatgcttgaatatattaatgtaagaaacgaaacgattccggaaaggtcggaagctttctttgttaaagaggatggtgagcggctttataagaatctggtctataatttagtgaaacggaacctgtcaaaggtggcgacgctgaaaaaaagaagtcctcacgtgctgaggcatacttttgctaccacaatgctgaataatgatgcagaactgggtgcggtaaaagaacttttgggtcacgagagtgttgcaactaccgagatctatacgcatgccacatttgaagaacttaaaaaagtgtataaacaagctcatccaagagcttaaaaaaaaggaggtaagtatggatattagaattcaatcaattcactttgatgcgtcagagcaattgcaggcatttattcagaagaaagtgtctaagttggaaaaatattacgaagatataaagaaagtagaggtgtcattaaaggtagttaagccggaagctgctgaaaataaagaggcgggcataaagattcttatccctaatggtgagttttatgcaagtaaagtgtgtgatacattcgaggaagcagttgatttggatgtggaggcgcttgaaaaacaactggtgaaatacaaggaaaaacagcgtagcaaataaaaaaatcgcaaatattttgcgggaaagaaataaataactaaatttgcagccgtttcgctcgcgttagaacgtgacggttgcattttttagctagaacgcctctttagctcagttggccagagcacgtgatttgtaatctcggggtcgttggttcgaatccgacaagaggctccaaggatgaatgaggatcatccggttttagcgaaagggatgacggtagtcaattcggttcgcgtggcgggaagaattagaagaagaactgagaataaaacatctatgttcagagtattgttcgctatttgattttaattctttgtttgaaatattaagggcaaataccagagtggccaaatggggcagactgtaaatctgctgtctttcgacttcggtggttcgaatccatctttgcccacaatcagagtgacaactttggcaagaatgcggaagtagctcagttgatagagcattagccttccaagctgagggtcgcgggtttgagccccgtcttccgctcttttttttcttgctgttatagctcagcggtagagcacttccttggtaaggaagaggtcccgggttcaagtcccggtaacagctcataaagatgtaaatgctgattattaatcaaataaataacaagtaaagctatggctaaagagaaatttgaacgtaccaaaccgcacgtaaacattggtacaatcggtcacgtagaccacggtaagacaacgttgacagctgctatcactactgtgttggcaaaaaaaggtctttctgagttgcgttctttcgattctatcgacaacgctcctgaagaaaaagaaagaggtattactatcaatacttcacacgttgagtacgaaacagctaaccgtcactacgcacacgttgactgtccgggacacgccgactacgtaaagaacatggtaactggtgctgctcagatggacggtgctatcatcgtttgtgctgcaactgatggtccgatgcctcagactcgcgaacatatcctgttggctcgtcaggtaaacgtacctcgtctggttgtattcttgaacaagtgcgatatggtagacgacgaagaaatgttggaactcgttgaaatggaaatgagagaacttctttcattctatgatttcgatggtgacaatactcctatcatccagggttctgctcttggcgcattgaacggtgttgaaaaatgggaagacaaagttatggaactgatggatgcagttgataactggattccacttcctccgcgcgatgttgataaaccattcttgatgccggttgaagacgtgttctctatcacaggtcgtggtactgtagcaacaggtcgtatcgaatctggtatcatccacgtaggtgatgaagttgaaatccttggtttaggtgaagataagaaatcagttgtaactggtgttgaaatgttccgtaaactgttggatcagggtgaagctggtgacaacgtaggtttgttgctccgtggtgttgacaagaacgaaatcaaacgtggtatggttctttgtaaaccgggtcagattaaaccgcactctcgcttcaaagctgaggtttatatcctgaagaaagaagaaggtggtcgtcacactccgttccacaacaaataccgtcctcagttctacttgcgtactatggactgtacaggtgaaatcactttgccggaaggaacagaaatggtaatgccgggtgataacgtaactatcactgtagagttgatctacccagtagcattgaacccaggtcttcgtttcgctatccgcgaaggtggacgtacagtaggtgctggtcagattactgaaattatcgactaatacacaataattaatcagttcccggttttactatcgggaactgattatgtacaaacgggagtagctcagttggtagagcaccggtctccaaaaccgggtgtcgggagttcgagcctctcctcccgtgctaatattattgaaatgaaaaaggtaatagcttatattaaagaatcttacgacgaacttgttcataaagtatcgtggcctacgtattccgaacttgctaacagtgcagtagttgttttatatgcttccctgcttattgcattggtagtatggggtatggatgtctgtttccagaacttcatggaaaaaattgtttatccacattaaaaaattaggaattgaaaatggctgagattgaaaagaaatggtacgttctacgtgctattagcggaaaagaagctaaggtaaaggaatatcttgaagctgaccttaaaaacagcgaccttggtgaatatgtatctcaggtattgattccaactgaaaaagtgtatcaggttcgcaatggtaaaaaaattgtgaaagagagaagttatctccctggttacgttttggtggaggctgctttggttggtgaggtcgctcatcatctgcgcaatactccgaatgtgataggctttttaggcggctccgagaaaccggtgcctctcagacaatcagaagtgaatcgtatacttggtacagtagacgaactacaggaaacgggtgaagaactcaatattccgtatgtagtgggtgagactgtgaaagttacttttggtcctttcagcggattcagtggtatcattgaagaagtgaatagtgaaaagaagaaactaaaggtcatggtgaagatattcgggcgcaaaacgccgcttgaattaggctttatgcaagtggaaaaagaataacgcggaattgttacgctgttgttgttcttcgtttaatgtttatatataaatcaataaaaaaatggctaaagaagttgctggactaatcaagttacagattaaaggaggcgctgcaaatccatcacccccagttggacctgctttgggttccaagggtattaatatcatggaattttgcaagcaattcaatgccagaacccaagacaaggcaggtaagattttgcctgttatcattacttactacgcagataagtctttcgattttgtaatcaagactcctcccgttgctattcaattgcttgaagtagctaaggtaaagagtggttctgctgagcctaaccgtaagaaagttgccgagcttacttgggagcagattcgtacgattgctcaggacaaaatggttgacttaaactgttttactgtggatgctgccatgagaatggttgctggtacagctagaagtatgggtatcgctgtaaaaggggagttcccggttaataactaataaacttcaattgtaatgggtaaactgacaaaaaatcaaaagttagctgcagaaaaaattgaagcagggaaagcatactcactgaaagaagctgcatctttagtaaaagaaattactttcactaaatttgatgcctcactggatattgacgtacgtttaggtgtagacccacgtaaagctaaccagatggtgagaggtgttgtttcacttcctcatggtactggtaaagaagtacgtgttttggtactctgtacaccggatgctgaagctgctgcaaaagaagctggtgctgactatgttggtcttgacgaatatattgaaaagatcaaaggtggatggactgatattgatgtaatcatcactatgccatctatcatgggtaaaattggtgcactcggtcgtgtactcggtcctcgtggattgatgcctaacccgaagagtggtactgtaactatggatgttgctaaagctgtaaaagaagtaaaacaaggtaagattgactttaaagttgataagagcggtattgttcatacttctatcggtaaggtatcattcagtcctgatcagattcgcgacaacgcgaaagagttcatctctactctgaacaaactgaaaccgaccgcagcaaagggtacatatattaagagtatttatctttctagtacaatgagtgcgggtatcaaaatcgacccgaaatcagtggatgaaatctaataaaacagagaaataatgagaaaggaagataaaaattcgattatagagcaaattgctgctacagtaaaggaatatggccacttctatttggtagacgttacagcgatgaacgctactgctacaagtgcattgagaagagattgtttcaagtctgacatcaaattgatggtagttaagaatacattgcttcacaaagctcttgaaagcctggaagaagacttttctcctctttacggttctttgaaaggtacaactgctgttatgttttgcaatactgcaaacgtacctgctaaactgatcaaggacaaagctaaagacggaattcccggactgaaagctgcatatgcagaagaaagcttctacattggtgcagaccaattggatgctctcgttgctatcaagagtaagaacgaagttatcgccgatatcgttgcattgttgcaatctccggccaagaatgttatttctgctcttcaatcaggtggtaacacccttcacggagttctcaaaactcttggtgagagacccgaataattttcaaaaaacaacaaagtatttaaacaattaaaatcatacaaaaaatggcagatttgaaagcttttgcagaacaattagttaacttgacagtaaaagaagttaatgaacttgcaactatccttaaagaagaatacggtattgaacctgctgctgcagctgttgctgttgctgctggtcctgcagctggtgctgctgctgtagaagaaaaaacttctttcgacgtagtattgaagagcgctggtgcagctaaacttcaggttgttaaggccgttaaggaagcttgtggtcttggtttgaaagaagctaaggacatggtagacggtgctcctagtgtagtaaaagaaggtttggctaaagacgaagcagaatcattgaagaaaacattggaagaagctggagctgaagttgaacttaaataacattagcctggtaatcaggtaattcggttaggaatccttcgcaagaggattcttaacctttttgtgtatatatttcaaattaagttctccaaattcattcacagatgtcttcaaatactgtaaatcaaagagttaattttgcttcgactaagaatccgcttgaatatccggatttcctggaagtacaattgaagtcattccaagactttctacaattagataccccacctgaaaagcgcaagaatgagggtttgtataaagtatttgctgaaaacttccctattgccgatacaagaaacaattttgttcttgagtttttggattattatattgatccgccgcgctataccatcgatgattgtatagagcgtgggctcacatatagtgttcctttgaaagcgaaacttaagctgtactgtaccgaccccgatcacgaggattttgatacagttattcaggacgtattcctcggcccgatcccttacatgactgataaggctactttcgtcattaacggtgccgaacgtgtagttgtgtcacagcttcaccgttctccgggtgtgttcttcggtcagagtgtacatgccaatggtacgaaactttactcggctcgtattattccgtttaaaggttcgtggattgagtttgctaccgacatcaataatgtgatgtacgcatacatcgaccgtaagaagaaattgccggtaactactttgttacgcgcgattggcttcgagaacgataaggatattcttgagattttcaaccttgcagaagatgttaaggtaaacaaaacaaatctgaagagagttctgggtcgtaagttagctgcacgtgttttgaaaacatggattgaagatttcgttgatgaagataccggtgaagtggtttctatcgaacgtaacgaggttattatcgaccgtgaaaccgtactggaggaagtacatattgatgaaattctggaatcgggagttcaaaacatccttttgcataaggacgagccgaatcaatctgatttctctattatatataatactctgcagaaggacccgagtaactcggaaaaagaagctgtgttgtatatctatcgtcagttgcgtaacgctgatccggccgatgatgcaagtgcacgtgaagttatcaacaacttgttcttctcagaaaaacgatatgaccttggtgatgtaggtcgttacagaatcaacaagaagctgaatctgacgactgatatggacgtgcgtgtcctcacgaaggaagatatcattgaaatcatcaaatatctgattgagttgattaactcaaaagcagatgtggatgatattgaccacttgagcaaccgtcgtgtacgtacagtaggtgaacagctttctaaccagtttgctgttggtctggctcgtatgtctcgtacgattcgtgaacgtatgaacgttcgtgacaatgaagtatttactccgattgatttgatcaatgcgaagactatttcttctgtgatcaattctttctttggaacaaatgctttgtcacagttcatggaccagacgaacccgttggctgaaattacgcacaagcgtcgtatgtctgcactggggcctggtggtctttctcgtgaacgtgccggatttgaggttcgtgacgttcactatacacactacggtcgtctttgtccgattgagactcctgaaggtccgaatatcggtttgatttcttccttgtgtgtattcgctaaaattaatgagctgggattcattgaaactccgtaccgtaaggtggaaaacggaaaagtggatctttccgataatggtctggtttatctgactgctgaagaagaagaagaaaagattattgcacagggtaatgctccgttgaatgatgacggtacatttgtccgcaataaagttaaatctcgtcaggatgctgacttcccggttgtagaaccgtctgaagtagatttgatggacgtttctcctcagcagattgcatcgattgctgcttcactgattccgttcctggaacatgatgatgctaaccgtgcattgatgggatcaaacatgatgcgccaggcagttcctttgttgagaagtgaagctccgattgtaggtacaggtatcgaacgtcagttagtgagagactctcgcacgcagattactgcagaaggcgatggtgttgttgacttcgttgatgctactacgatccgtattttgtatgaccgtacagaagacgaagaatttgtaagcttcgagcctgctttgaaagaatatagaattccgaagttccgtaagacgaaccagaacatgacaattgacttgcgtccgatttgtgacaaaggtcagcgcgtgaagaagggtgatatcctgactgaaggttattctaccgaaaagggtgaattagctttgggtaaaaacctgttggttgcttatatgccatggaagggatataactatgaggatgctatcgtattgaacgaacgcgtggttcgcgaggacttgttgacttctgttcacgtagaagaatactctctggaagttcgtgaaacgaagcgcggtatggaagaattgacttctgatattccgaatgtaagtgaggaagctactaaagacttggatgaaaatggtatcgtaagaatcggtgcgcgtatcgaaccgggtgatatcatgatcggtaagattactccgaaaggtgaatctgatccttctccggaagaaaaactgcttcgtgctatcttcggtgataaggcaggtgatgtgaaagatgcttctttaaaagcttctccttctttgaaaggtgttgttattgataagaaacttttctcacgtgtaatcaagaaccgtagctctaaactggcggataaagcattgttgcctaagattgacgatgagtttgaatcaaaggttgcagacttgaagcgtattctggttaagaaactgatgactttgactgaaggcaaggtttctcagggtgtgaaagactacttaggagcagaagttattgctaagggatctaagttcagtgcttctgattttgattcactcgactttacttctattcagctgagtaactggactagtgatgaccatactaatggtatggttcgtgatctggttatgaactttatcaagaaatacaaagagctggatgctgaattgaagcgtaagaagtttgctatcactatcggtgatgaacttccggctggtatcattcagatggctaaagtatatattgctaagaaacgtaagattggtgtaggtgataagatggcaggtcgtcacggtaacaagggtatcgtgtcacgtgttgtacgtcaggaagatatgccgttcctggcagatggtactccggttgacattgtactgaatccgttgggtgtgccttctcgtatgaacattggtcagatttttgaagctgtattaggtcgcgccggaaaaactttgggcgtgaaatttgcaactcctatttttgacggtgctacgatggacgacttggatcagtggacagacaaagcgggattgccacgttactgtaaaacttatctttgtgatggtggtacaggtgagcaatttgaccaggcagcaaccgtaggtgtgacttatatgctgaagctgggacacatggttgaagacaagatgcacgctcgttctatcggtccgtactcattgattactcagcaacctcttggtggtaaagcacaattcggtggtcagcgtttcggagaaatggaggtttgggcactcgaaggcttcggtgctgctcatatcctgcaggaaatcttgactattaagtctgatgacgtagtaggacgttctaaggcttatgaagcaattgtgaaaggtgaaccgatgccgcaacccggtattccggaatccttgaacgtattgttacacgagttgagaggtttaggtttgagtatcaacctagaataaaataatgaaagaatgcaggatgtcaataggccgatgaaggtctgttgacattcgcatcttcttcaatttccaatgattcaattatcaaatctcaattatatagagtatggcttttagaaaagaaaataagacgaaaagcaatttctcgaagatctcaattggtctggcttctccggaagaaatcctagagaattcgagtggtgaagttttgaagcctgaaaccataaattaccgtacgtacaaacccgaacgcgatggtttgttctgcgagcgcatttttggtcctattaaggattacgaatgccattgcggtaaatataagcgtatccgttataaaggtatcgtctgcgaccgttgtggtgtagaagttacagaaaagaaagtacgccgtgaacgtatgggacatatacagctggtggtgccggtggcacacatctggtatttccgttcgcttccaaataagatcggttatttgctcggactgccgacaaagaagctggattcgattatatattacgaacgttatgttgttattcagccgggtgtaaaggctgaagatggcattgccgaatatgacttactttctgaagaagaatatctggatattctggatacacttccgaaggacaatcaatatctggaggataatgatccgaataagttcatcgctaagatgggagctgaagcaatctatgatttgctggctcgtttggatctggatgctctgtcttatgaattgcgtcaccgtgcaggcaatgatgcttcacagcaacgtaagaatgaggcattgaaacgtctacaggttgtagaatcgttccgtgcatcacgtggacgtaacaagccggaatggatgattgtacgtatcgtaccggttattccgcccgaactccgtccattggttccattggatggtggtcgttttgctacttctgacttgaatgacctttatcgtcgtgttatcattcgtaacaaccgtctgaagagattgatcgaaatcaaagctccggaagtaatcttgcgtaatgagaaacgtatgcttcaggaatctgtagactcattgttcgataattcacgtaaatcaagtgcagtgaagacggatgctaaccgtccgttgaaatcactgtctgatagcttgaaaggtaaacaaggacgtttccgtcagaacttgctgggtaaacgtgttgactactctgcacgttcggtaattgttgttggtccggaactgaagatgggtgagtgcggtattcctaaattgatggctgccgaactttataagccgtttattatccgtaagctcattgaacgtggtatcgttaagacagtgaaatctgcaaagaagattgtagatcgtaaggaagcggtgatctgggatattctggaacacgtaatgaaaggacatcctgtactgttgaaccgtgctccgacattgcaccgtttgggtatccaggcattccagccgaagatgatcgaaggtaaagctatccagttgcacccgttggcatgtacggcattcaacgctgacttcgacggtgaccagatggctgttcacttgcctttgagtaacgaagcaattcttgaagctcagatgttgatgcttcagtcacataatatcctgaatccggcaaacggtgcgcctattactgtgcctgcacaggatatggttcttggtttgtattacattaccaagttgcgtgccggtgctaagggagaaggacttacattctacggaccggaagaagcattaatcgcttataatgaaggtaaggtagatattcatgctccggtaaaggtgatcgtgaaagacgttgatgaaaatggtaacattgttgacgttatgcgtgaaacttctgtaggacgtgtgattgttaatgaaattgttcctcctgaagcaggttatatcaatacgattatttctaagaaatctcttcgtgatatcattagtgatgtaatcaaggtttgtggtgtggctaaagctgcagacttcttggatggaatcaagaacttaggttaccaaatggcctttaagggtggtttgtcattcaacttgggtgatattattatcccgaaagaaaaagagacattggtacaaaaaggttacgacgaagttgaacaagtcgtaaacaactataatatgggtttcattaccaacaacgaacgttataatcaggtaattgatatctggacacatgtgaactctgagttgtctaacatcttgatgaaaactatttcttcggatgaccaaggatttaactctgtatacatgatgctggattcgggtgcccgtggttctaaagaacagattcgtcagttgtccggtatgcgtggtttgatggctaagccccagaaagctggtgctgaaggtggtcagattattgaaaacccgatcttgtcaaactttaaagagggactttctgtgttggagtactttatctctactcacggtgcccgtaaaggtttggcggataccgctttgaagactgccgatgccggatatttgactcgtcgtctggtagacgtttctcacgacgtgatcatcacggaagaagactgcggtacacttcgtggattggtttgtacagacttgaagaataacgatgaagtaatcgctaccctgtatgaacgcatcttagggcgtgtttctgtacatgatattattcatcctactacaggcgaattgcttgttgccggtggtgaagaaatcacagaagaagttgctaagaagattcaggattctccgattgaaagcgttgaaatccgttctgtattgacttgtgaagcgaagaagggtgtttgtgctaagtgttacggacgtaacctggcaacaagccgcatggttcagaagggtgaggctgttggtgtaattgctgctcagtcaatcggtgagccgggtacacagttgacattgcgtacattccacgccggtggtactgctgcgaatattgcggcaaatgcaagtattgtggctaagaacagtgctcgtctggaatttgaagaacttcgtacggtagatatcgtagacgaaatgggtgaagctgcaaaagtagtggtaggccgtttggctgaagttcgttttgtggacgtaaatactggtatcgttctttctacgcacaatgtaccttatggttctacattatatgtatcggatggtgatctggttgaaaagggtaagttaattgctaaatgggacccgttcaatgccgttattataactgaagcaactggtaagattgaattcgaaggtgtaattgagaatgttacctataaagtggaatcggatgaagcaacaggtcttcgtgaaatcatcattattgaatctaaggataaaacgaaagttccttcggctcatatcctgacagaagacggcgatctgattcgtacttataacttaccggtaggtggtcacgtgattattgaaaatggtcagaaagtgaaagccggtgaagtaatcgtgaagattccgcgtgctgtaggtaaggcgggtgacatcacgggtggtctccctcgtgttactgagttgtttgaagcacgtaatccgtctaatcctgctgtcgtttctgaaattgacggtgaggttacaatgggtaagatcaagcgtggtaaccgtgaaatcatcgtaacttcgaaaacaggtgaagtgaagaagtatcttgttgcattgtccaaacagattctggttcaggagaacgactatgtgcgtgctggtactccattatctgatggtgctactactccggctgatatcctggcaattaaaggtcctacggctgtacaggaatatattgtgaatgaagttcaggatgtataccgtctgcagggtgtgaagatcaatgataagcattttgagattatcgttcgccagatgatgcgtaaggttcagatcgatgagccgggtgatactcgcttcttggaacaacaggtagtggataagcttgagtttatggaggaaaacgatcgtatctggggtaagaaagtggttgttgatgcaggtgattctcagaatatgcagccgggacagattgtgaccgcccgtaagttgcgtgatgagaacagtatgctgaagcgccgtgacttgaaacctgttgaggtacgtgatgctgtagctgcaacttctactcagattcttcagggtattacgcgtgctgcactgcagacttcaagctttatgtcagctgcatccttccaggaaacaacgaaggtgttgaatgaggctgctatcaatggcaagacagataaacttgaaggaatgaaggaaaacgtaatttgcggtcacttaattccggcaggtacaggtcagcgtgaatttgaaaagattatcgttggttcaaaagaagagtatgatcgtatcttggcgaacaagaagacagtacttgattacaatgaagtagaataatacaattcaattgactatatgaaaaaggagcgattgctgtagcaggcagttgctcctttttttgtttcttttacctgactgtatcattcttatctcgataaaattttgttattttgcaaaaaaacattttatcttatttaatatggaagaacaaaataacaaccagttacagatcgagttgaaagaagaagtagcgcaaggaacttatgcgaatcttgcaatcattactcattcaagctctgagtttattctagactttgtacgggttatgccaggagtgccgaaagcaggagtgcaatctcgtattatagtagctccagaacacgcaaaacgcttgttgcgggcattggaggataacatagcaaagtatgaacgtgcttttggacctattcgtatttctgaagagtcaccgatgcctccgctaagtgttgtaaaaggcgaagcatgaggttgatataaaaacattaaaaaagaaaaaaaagttgtagcgcattgaatattcaaatattattcgtatttttgcagcccaaaatgtatagttacgaaattaatataacaataatataaatcaaaaaacaattaaaatgcctacaattcagcaattagtaagaaaaggacgcgaagcgctggtggagaaaagtaaatctccagccttggattcatgtcctcaaagacgtggcgtttgcgtgagagtatatactactactccgaagaagccgaactctgcaatgcgtaaagtagctcgtgtacgtttgactaaccaaaaagaggttaactcatacattccgggagaaggacacaacttgcaggaacactcaatcgttttggtacgtggcggtcgtgtaaaagaccttcctggtgtacgttaccacattgtacgtggtacacttgatactgcaggtgttgctggtcgtactcaaagacgttctaaatacggagctaagcgtccgaaaccaggacaagctgcgccggctaagaaaaaataaggattaaaacctaattagaattaaagtaataacttacgttttagtttgttggaaatgctaaaggttgagtaaattctccggtgggagagttgaagaagtcaagaagtagacagccaagaacaaaaacattatttttcaaacaaatgagaaaagcaaaaccaaaaaaacgcgtaatccttccggatcccgtttttaatgaccaaaaggtttctaagtttgtaaaccatttgatgtatgatggtaaaaagaatgcgtcttatgaaatcttttatgccgctctggaaacagtgaaagcaaaacttcctaacgaagaaaaatcagctctcgaaatctggaaaaaggctttggataatgtaactccgcaagtagaagtaaaatctcgtcgtgtaggtggtgctaccttccaggttcctactgaaatccgtcctgatcgtaaagaatcggtttcaatgaaaaacttgattctgtttgctcgcaaaagaggtggtaaatctatggcagacaaattggctgctgaaatcatggatgcctttaacgaacagggtggcgcatacaaacgtaaagaagatatgcatagaatggctgaagctaaccgtgcatttgctcatttcagattctaatactataagaatataaccgatttagattaaaaacttaaagtaaaggaataagaaaatggcaaagacagatttacatttgactcgtaatatcggtatcatggctcacattgatgccggaaaaacaacaacttctgaacgtatcctgttctacactggattgactcacaaaattggtgaggtacacgatggtgctgcaacaatggactggatggaacaggagcaagaacgtggtattactattacatctgctgcaacaacaacaagatggaaatatgctggtgatacttataaaatcaacttgattgatactccgggacacgttgactttactgctgaagtagaacgttcgttacgtattctggatggtgctgtggctgcttactgtgcagtaggtggtgtagaacctcaatcagaaactgtatggcgtcaagctgataagtataatgtgccacgtattgcgtacgtaaacaaaatggaccgttcgggtgctgacttctttgaggttgtacgccagatgaaagctgttttgggtgctaatccttgtccaatcgttgttcctattggtgctgaagaaaccttcaaaggtctggtagacttgattaaaatgaaagctatctattggcatgatgaaacaatgggagctgactatacagttgaagaaataccggcagatctcgttgatgaagcaaatgaatggagagataaaatgcttgaaaaggtagctgagtttgacgatgctttgatggagaaatatttcgacgatccttctactattacagaagaagaagtgttgagagccctccgcaatgcaacagttcagatggcagttgtaccaatgttgtgtggctcttcatttaagaataagggtgttcagacattgttggactatgtttgtgctttcttgccttctccattggatactgagaatgtgattggtacaaatccgaatacaggtgcagaagaagatcgtaaaccgagtgatgatgagaaaacatcagctttggcatttaagattgctactgacccttatgtaggtcgtttgactttcttccgtgtatattcgggtaagattgaagctggttcttatatctataattctcgctctggtaagaaagaacgtgtttctcgtctgttccagatgcattcaaacaagcagaatccggttgaagtaatcggtgctggtgatattggtgcaggtgtaggttttaaagatattcatactggtgatacgctttgtgatgaaacagctccgatcgtattagagtctatggacttcccggaaccggtaatcggtattgcagttgagcctaaaactcagaaagacatggataaattgtctaacggtttggctaagctcgctgaagaagatccgacatttacagttaagactgatgagcaaactggacagactgtaatctctggtatgggtgagttacacttggatatcattattgaccgtttgaaacgtgaatttaaagtagaatgtaaccaaggtaaacctcaggttaattataaagaagctatcactaagacagttgatcttcgtgaagtttataagaaacagtctggtggtcgtggtaagtttgcagatatcatcgttaagatcggtcctgttgatgaagatttcaaagaaggcggattgcagtttatcgatgaagtgaagggcggtaatattcctaaagaatttattccttcagttcagaaaggtttcacaagcgcaatgaagaacggtgtgttggccggatatccgttggattcaatgaaggtaactttgattgatggttcattccatccggttgactctgaccagttgtctttcgaaatttgtgctattcaggcatataagaatgcatgtgctaaagcaggtccggtattgatggagcctatcatgaagctggaggttgttactccggaagaaaacatgggtgatgtgatcggtgacttgaataagcgtcgtggtcaggttgaaggtatggaatctagccgttccggtgctcgtattgtgaaagcaatggtgccactggctgaaatgtttggttatgtaacagcgttacgtactattacatctggtcgcgcaacttcatcaatggtatattctcatcacgctcaagtttctaactctattgctaaggcagtattggaagaagtaaaaggacgtgctgatttactctaaaagaatatcaaaagcagcaggctagcgaatgactcttagcctgccgctttctcttatttataaatatattaatttaaaaccataatgagtcagaaaattagaattaaattgaaatcttacgaccacaacttggttgacaagtcagctgagaagattgtaagaaccgtaaaggctacgggtgctattgttagtggtccaattcctctgcctacgcacaagcgtatctttacagtgaaccgctcgactttcgttaacaagaagtcacgtgaacagtttgaactctcttcttataagagattgatcgacatctatagctcaactgctaagacggtagatgctcttatgaagcttgagttgccgagtggtgtggaagtagaaattaaagtttgataattaaaaattagtgaaatgccaggattattaggaaaaaaaatcggaatgacatccgttttcagtgctgatggtaagaatgtaccatgcactgttatcgaagcaggtccttgtgttgttactcaggttaaaactgtcgaaaaagatggctatgcagctgttcagttgggtttccaggacaaaaaggaaaaacatacaactaaaccgttgatgggccacttcaagagagctggagtaacaccgaagagacacttggccgagttcaaagaatttgagacagagttgaatctgggtgatactattactgtagagatgttcaatgacgctactttcgtagacgttgtcggaacttctaaaggtaaaggtttccagggtgtagttaagagacatggtttcggtggtgtaggccaagctactcacggtcagcacaaccgtgctcgtaagccgggttctatcggtgcttgttcttatccagctaaagtattcaaaggaatgcgcatgggcggacagctcggtggtgacagagttactgttcaaaacttgcaggtattaaaagtaatcgcggatcataaccttcttttgatcaaaggttctatcccgggttgcaaaggttcaatcgtaataattgagaaataatggaagttaacgtatataacattaaaggtgaagacactgggagaaaggttacgttaaacgaatctatcttcggaattgagcccaacgaccacgctatctatttggatgtaaagcaatttatggccaaccagcgtcagggtactcataagtcaaaagaaagaagtgaaatcagtggctctactcgtaagatcggtcgccagaaaggtggtggtggagcacgtcgtggtgatatgaattcaccggtactcgttggtggtgctcgtgtttttggtccgaaaccaagagactacttcttcaagttgaataaaaaagttaagacattggctcgtaagtcagcattgtcttataaagttcagaacaacgcgcttattgttgttgaagacttcgtttttgaagctcctaagacaaaagatttcgttgctatgacaaaaaatcttaaagtttccgataaaaagctacttgtaattttaccggaagcaaataaaaacgtatatttgtcagctcgtaacatagagggtgcaaacgtgcagactgtctcaggattaaatacttacagagtattgaatgctggggttgttgtgcttacagaaaactctctgaaggctattgacaatatcttaatttaaaaaggaggcttaaataatgggaattattattaaaccgttggtaacagagaaaatgactgcaatcactgataagctgaatcgtttcggctttgttgtacgtcctgatgctaacaaactggaaattaagaaggaagttgaagctctttataatgttactgtagttgatgtgaatacagtgaagtatgctggcaaaaataaaagccgttatactaaagcaggtatcatcaatggccgtacgaatgcattcaaaaaagcaatcgtaacattgaaagaaggagatactattgatttttatagtaatatttaataaaaatggcagtacgtaaattaaagcccacaacaccggggcaaagacataaaattattggtactttcgaagaaattactgcatcagtaccagaaaagtctcttgtatatggtaagaaatcatctggtggtcgtaacaacgaaggtaagatgactatgcgctacattggtggcggtcatagaaaggtgattagaattgttgatttcaagagaaacaaagacggtgtaccagcagtggttaagacaattgaatacgatccgaatcgttcggctcgtatcgctttgttatattacgctgatggagaaaaaagatatattattgctcccaatggattgcaagttggtgcgactctgatgtcgggtgaaacagcagcgccagagattggtaatactcttccccttcagaatattccggttggtactgtaattcacaatattgagttacgtccgggacagggtgctgctctggttagatcagctggaaactttgctcagttaacttctcgtgagggtaagtattgtgtgattaaattgccttcaggtgaagtaagacagattcttagcacttgtaaagctactatcggtagtgttggtaactcagatcatggattggaacgctcaggtaaggctggacgctctcgttggcaaggtcgtcgtcctcgtaaccgtggtgttgtaatgaacccggttgatcacccgatgggtggtggtgaaggacgttcttccggaggacatccaagatctcgtaagggattgtacgctaagggacttaagactagagctcctaagaaacaatcgtctaagtacattattgagagaagaaaaaagtaatctgattaattgagtaaactatgagtcgttcattaaaaaaaggtccatatattaacgtaaagcttgaaaagagaatttttgccatgaatgaatctggcaaaaaagtcgtagtaaagacatgggccagagcttcaatgatttcgcctgattttgtaggccatacagttgcagttcacaatggaaataaatttattcctgtatatgttaccgaaaatatggtaggacacaagttgggcgaatttgctccaactcgtacattcagaggacacgctggtaacaagaaaagataacaggaattatttgaaataataaagtaataaatataatgggagcaagaaaaaaaatatcggctgaaaaaagaaaagaagcccttaagaccatgtattttgctaaattgcaaaatgttcctacttctccacgtaagatgcgcttagtcgctgatatgattcgtggtatggaagtgaacagagcacttggtgttttgaaattttcttcaaaagaagctgctgcaagagtggaaaaattgcttcgctctgcaattgctaactgggaacagaaaaacgaacgtaaagcagaaagcggcgagttgttcgtaacgcagatttttgttgatggtggcgctacactcaaaagaatgagaccggcaccgcagggtagaggttatagaattcgcaaacgttcaaatcacgtaacattgttcgttggtgctaaaagtaataacgaagatcaaaattaaggtagatgggacaaaaagttaatccaataagcaaccgtttaggaattatcagaggatgggattctaactggtatggtggaaatgattacggtgattctttgctggaagatagcaaaatccgtaaatatcttaatgcaagacttgcaaaggcaagtgtatcaagaatcgtaattgaacgtacgctgaagctcgttactattactgtttgcactgctcgcccgggtattatcatcggtaaaggtggccaagaagttgataagttaaaagaagagttgaagaaggttaccgacaaagatattcagattaatatctttgaagtgaaaagaccggaactggatgctgtaattgttgctaacaacattgctcgccaggtagaaggtaaaattgcctaccgccgtgccattaaaatggctatcgcaaatacaatgcgtatgggtgctgaaggtatcaaaattcagatttcaggacgtttgaatggagctgaaatggctcgttctgaaatgtataaagaaggaagaactccgttgcacactttcagagctgatatcgactactgtcatgctgaagcattgactaaagtgggtcttttaggtatcaaagtttggatttgtagaggtgaagtgtttggtaagaaagaattagctccgaactttacacaaagcaaagaaagtggtcgtggaaacaatggtggaaacaacggcggaaagaacttcaaaagaaagaaaaataatcgctaaacgaatttgaattttaggaaactatgttacaaccgaaaaagacaaaattcagaagacaacaaaaaggccgtgcaaaaggtaatgcccagagaggtaaccagctggctttcggttcttttggcattaaggctttggaaactaaatggattacaggccgtcagatcgaagctgctcgtattgcagtaacaagatatatgcaacgtcaaggacagatctggatccgtatattcccggataaaccaattactagaaaacctgccgatgtgcgtatgggtaaaggtaaaggtgctcccgagggatttgtggctcctgtaactccaggtagaatcattattgaagctgaaggagtatcttacgaaatcgcgaaagaagcattgcgcttagctgctcaaaagcttcctattacaacgaagtttgtcgtaagacgtgattatgatattcaaaatcaaaatgcgtaaggtttatgaaaattgcagaaattaaagaaatgactactaatgatttagtagaaagagtagaggcagaaacagctaattataaccagatggttatcaatcattctatttctcctttggaaaatcctgctcaaatcaaacaattacgcaggactattgcgcgtatgaaaacagaattacgccaaagagaacttaacaataaatgatcagcttgatggaagcaagaaatttaagaaaagaaagaacaggggttgtattgagcaacaagatggaaaaaactatcacagttgctgccaagtttaaagaaaaacaccctatatatggtaagttcgttagtaaaacgaagaagtaccatgctcatgatgaaaagaatgaatgcaatatcggtgatactgtacgcatcatggaaactcgtcctttgagcaagactaaaagatggagattagtagaaataattgaaagagctaagtaattatgatacaagtagaatccagacttacagtatgtgataacagtggagctaaagaagctttgtgtatccgtgtattgggtggcacaggtcgtcgttacgcttcagtaggagatgttattgtagtttccgtaaagagtgttatcccttcgagtgatgttaaaaaaggtgcagtatcaaaggctttgattgtacgtacgaagaaagaaatccgtcgtcctgatggttcttatatacgttttgatgataatgcttgcgtgttgcttaataatgcaggtgaaattagaggaagtcgtattttcggtcctgtagcaagagaacttcgtgctacaaacatgaaggttgtgtcacttgcgcctgaggtactttaattttgtaaaagatttgagtaatgagtaaattacatattaaaaaaggcgatacagtttacgtaaatgctggcgaagataagggcaaaactggtcgtgtattgaaggttcttgttaaagaaggtcgtgcaattgttgagggtatcaatatggtatctaagagcactaagccgaatgcaaagaatccgcagggtggtattgtgaagcaagaagcttctatccacatttcaaacttgaacccggttgatccaaaaactggtaaagcaacgcgtattgggagaagaaagagttctgaaggaactttagtgcgttattctaaaaaatcaggagaggagatttagtaatgagtaatactgctagcctaaagaaagaatatgcagatcgtattgcacctgcattgaaatcacaattccagtattcttcaacgatgcaggtacccgtacttaagaagattgttatcaatcaaggtttaggtatggctgttgctgataagaagattattgaagtagcaatcaatgaaatgacagctatcacaggtcagaaggccgtagctaccatttctcgtaaagatatcgcaaactttaagttacgtaaaaaaatgccgattggcgttatggtaactttgcgccgtgagagaatgtatgaattcttggaaaaactagttcgtgtagctcttcctcgtattcgtgacttcaaaggtatcgaaagtaagtttgatggtaaaggtaactatacccttggtattcaggaacaaatcattttccctgaaataaatatcgatagtattacaagaattctcggaatgaatattacctttgtaacttctgcggagacagatgaagaaggttatgccttgttgaaggaattcggtttaccttttaaaaacgctaaaaaagattaatagaatatggcaaaggaatcaatgaaggcacgtgaagtaaagcgtgctaaattagtagccagatacgccgagaaaagagctgctttgaagcaaatcgtgagaacaggtgaacctgccgatgcttttgaagctgcacagaaattgcaagagttgcctaagaattcaaatccgattcgtatgcacaaccgttgcaaactgactggtcgtccaaaaggttatatccgtcagttcggaatttcaagaatccagttccgtgagatggcatctaacggtctgatcccgggcgtaaagaaagcaagctggtaattattgtttaaatattgtcagggaagtcctgattaatttaatttatttttatatgactgatccaatagcagattatttgacgaggttgcggaacgcaattggtgctaagcacagagttgtagaagttcccgcttcgaacttgaaaaaagaaatcactaagattctttttgaaaaaggctacattcttaactataagtttgtagaagatggtcctcaaggaactatcaaggttgccttgaagtatgattctgttaacaaagttaacgcaatcaaaaaattagaaagagtatcttctccgggtatgcgtaagtatactggttacaaagatatgccgcgtgttattaatgggctgggtattgctataatatctacttccaaaggtgtaatgactaacaaagaagctgctgaactgaaaatcggtggtgaagtcttgtgttacgtatattaatttaggaggaataagcaatgtcaagaataggaaaattacccattagtatccctgctggagtgacagtcactctgaaggatgatgtggttaccgttaagggacccaaaggcgaacttagccaatatgtgaatcctgctatcaatgttgccattgaagacggacacgtgactttaacagaaaacgaaaaagaaatgattgataacccgaagcaaaagcatgctttccacggtttgtatcgttctttagttcataacatggttgtgggcgtgtctgaaggatataaaaaggaactggaacttgtcggtgtaggttaccgtgcttctaaccaaggtaacatcattgaactggctttaggttatacacacaatattttcattcaattgcctgctgaggtgaaagttgaaactaagtctgaaagaaataagaatcctcttattatattggaatcgtgtgacaaacaattgcttggtcaagtttgctctaaaatacgttctttccgtaaacctgaaccatataagggtaaaggtattaagtttgttggcgaagtaattcgtagaaagtctggtaaatcagccggcgctaagtaaatcatataaaattagattattatgacaacaaaaatagaaagacgagttaagatcaaatatagagtacgcaataagatttcaggtactgctgaacgtccgcgtatgagtgtatttagaagtaacaagcaaatttatgtccagattatcgatgatctttctggtaagacactggctgctgcttcttctttaggtatggctgagaaagtcgcaaagaaagaacaagctgctaaagttggtgaaatgattgctaaaaaggctcaggaagcaggtataactactgttgttttcgaccgtaatggttacttgtatcatgggagagtaaaagaagtagctgatgctgctcgtaacggtggacttaaattttaatcattatggcaggagttaataatagagttaaggttactaacgatatagaactgaaggatagattggttgctattaatcgtgttactaaagttaccaaaggtggtagaacttttagtttctctgcaatcgttgttgtaggtaacgaagaaggtattatcggttggggacttggtaaagcaggtgaagtaacagctgctatcgctaaaggcgtagaatcagctaaaaagaacctggtgaaagtacctgttttgaaaggtactgttcctcatgaacaatcagctaagtttggtggtgctgaagtattcatcaaacctgcatctcacggaaccggtgtagtagctggtggtgctatgcgtgctgtattggaaagtgttggtattactgacgttttggcaaaatctaaaggttcttcaaatccgcacaaccttgttaaagctacaattgaagctttgagtgagatgcgtgatgcaagaatgattgctcagaacagaggtattagtgttgaaaaagtatttagaggataaggaggagatatgtcaactataaagattaaacaagttaaaagtagaattggtgctccagctgatcagaaaagaactcttgatgcactgggacttcgcaaactgaaccgtgtggttgaacacgaaagcactccttcaattcttggaatggtagataaagtaaaacacttggttgccattgttaagtaattatttgttgaataaaaaaacgaattacaatatgaacttaagtaatttaaaacctgcagaaggatctactaagacaagaaagagaataggacgtggtgccggttctggcttgggtggtacttctacaagaggtcataaaggagctaaatcaagatctggatactctaagaaagttggctttgaaggtggtcagatgcctcttcaacgtcgagtacctaaatttggttttaagaatatcaatcgtgtagaatataaggctatcaacttggatacaattcagacgcttgcagatgctaagaatctgacaaaagttggtattagcgactttattgaagcaggatttatttcttcaaatcaattggttaaagtattgggtaacggagctctgactaacaagctggaagtagaagctaacgcattctctaagagtgctgctgctgctattgaagctgctggtggaactgtagtaaaactctgattcaatgagaaaagctattgaaacattaaagaatatatggaagattgaggatctgagacagcggatcctcatcaccatattgtttgtggcaatttaccgtttcggatcatatgtcgtattaccgggtattaatccggcaatgttggcaaaattgcacgaacaaacaagtgaaggccttttagccttgttaaatatgttctctggaggagcattttctaatgcctctatttttgcattaggaatcatgccttatatctctgcatctatcgttattcagctattgggaatcgctgtgccgtatttccaaaagttgcagcgcgaaggtgagagcggcagaagaaaaatgaatcaatatactcgttatctgacgattgctatattgttagttcaggccccttcttatttgctcaatcttaaaatgcaggctggcccttccttaaatgcttcattagattggactctgtttatggttacctctaccattattttggcagcaggtagtatgtttattttgtggcttggtgaaagaataactgataaaggtattggtaacggtatttcatttatcatcctgatcggtattatcgctcgtttccctgatgctttgatacaagaagttgtatccagagtagcaaataagagtggtggtctgattatgtttataattgaagtcgtattcttattgttagtgattggtgctgcaatcttgttggtacaaggtacaagaaagattcctgtacaatatgctaaaagaatcgtaggtaataaacaatatggtggtgcaagacagtatattcctttgaaggtgaatgctgctggtgtaatgcctataatctttgctcaggcaatcatgtttattccaattacatttatcggtttttccaataatgtaaataacgcaggcggtttcttgcatgcgtttacagatcatacaagtttctggtataattttgtttttgcggtaatgattatattatttacatatttctatactgcaattacaatcaatccgactcagatggctgaggatatgaagagaaataatggtttcatccctggtatcaaaccgggaaagaaaacagcagagtatattgatgatatcatgtctcgtattactttaccgggttcttttttcttggcattggttgctattatgcctgcttttgctggtatatttggggttcaagctggatttgctcaattcttcggcggtacatctttgttaattcttgtaggtgttgttcttgatacactgcaacaggttgaaagtcatttgttgatgagacattatgatggtctgttgaaatcaggtcgtattaagggacgcgctggtgtagcggcatattaattctttagaatagaaatgatatttcttaagacagaagatgaaatagaattgctccgtcagagtaacctgcttgtcggtagaactctagctgaggttgctaaagtggtgaagcctggtgtaactacacgtgagttggataaagttgctgaagaattcattagagataatggggcaactccaacttttaaaggattcccgaatcaatatggagacccgtttcctgcatccatctgtacttctgtaaatgagcaggtagtacatggaatcccgggggatattgttctgaaagacggcgatatcgtatctgtggattgcggaacttatatgaatggtttttgtggagattctgcttatactttttgtgtaggagaggtagacgaagaaattcgtaacttgttgaaggtaactaaagaagcgttatatatcggtattcagaatgcagtgcatggaaaaagaatcggagatatcggatatgctattcagcaatattgtgagtctcattcttatggtgtagtgcgtgagtttgtcggtcacggcatcggtaaggaaatgcacgaagatccccaggtacctaattatggtaaaagaggatatggtcctttgatgaaaagaggtctttgcattgcaattgagccgatgataacgttgggagacagacaagtgattatggaaggtgacggatggactgtgaggaccagagatcgtaaatgtgctgcgcactttgagcatacggtagctgttggagctggtgaggctgatattttgtcttcattcaaattcatagaagaagttttaggagataaagcaatataatatggcaaagcaatctgcaatagaacaagatggagttatagttgaagcattgtctaatgcaatgtttcgtgttgaattagaaaacggacatgagattactgcacatatttcaggtaagatgcgtatgcattacatcaagatcttgccgggagataaagtgagagtcgaaatgtctccttacgacttatcgaaaggaagaattgtgtttagatataaataaaattaagatatgaaagtaagagcatcattaaagaaacgcacgccagaatgtaagatcgttagacgtaatggccgtttgtatgttattaacaagaaaaatcctaagtataaacaacgtcaaggataatttgttatttttgcaaaaaaaataatttagtatatggctataagaatagttggtgtagatttacctcagaataaaagaggtgaaattgcgttgacctatgtatatggaataggtcgcagtagttcagcaaaaattttagataaagctggtgtagataaagatctgaaggttaaagactggacagatgatcaagctgctaagattcgtgagattatcggtgcagagtataaagtagaaggtgatcttcgttctgaaatccaattgaacattaagcgattaatggatattggttgttaccgtggtgtacgtcatcgtattggtctgccggttagaggtcagagcactaagaacaatgcacgtactcgtaagggtagaaagaaaaccgttgctaataagaaaaaagctactaaataataattgttgatatggcaaaaaaaacagttgcagctaagaagagaaatgtgaaagtagacgctaatggacagttacacgttcattcatctttcaacaatattattgtttctcttgcaaacagtgaagggcagattatctcttggtcatctgcaggaaagatgggatttagaggttcaaaaaagaatactccttatgcagctcagatggctgcccaagattgtgcaaaaattgcatttgatcttggcctgagaaaggtaaaagcatatgtgaagggtccaggtaacggacgtgagtctgctattagaactatccacggagctggtattgaggttacagagatcatcgacgtaactccacttccacacaatggttgtcgtcctccgaaaagacgtagagtttaatttacctttaacttaaaatgatcttgattttgtttttggattgcaataatttcttctctgcaatcgcggctgcaacaaattgagttcatgaataaacaattaaatatttaaaagaaatggctagatatactggaccaaaatcaagaatagcccgtaaattcggtgaaggcatctttggagctgataaagttttgtcaaagaagaactatcctcccggacaacacggaaattcaagaaaaagaaaaacttctgaatatggtgtgcaacttcgtgaaaagcagaaagcgaaatacacttatggagttttagaaaaacaattccgcaatttgtttgaaaaagccgctaccgctaaaggtattaccggtgaggtgcttcttcaattgctggaaggccgtcttgacaacgtagtattccgtttgggtattgctcctacacgtgctgctgctcgtcagttggttagtcacaagcatattactgtagatggtgaagtggtaaacattccttcattcgcagtaaaaccaggacaattgattggtgttcgtgaaagatctaaatctttggaagtaattgctaactctcttgcaggtttcaatcacagcaaatacgcttggttggagtgggatgaaacttctaaggtcggtaaaatgttgcatatacctgaaagagcagacattcctgagaacattaaagaacatttgatcgttgaattgtattctaaataataattaatttcatggcgatattagcatttcaaaaacctgataaagtattaatgttggaggcggactccagattcggtaaattcgaatttcgtccgttggaaccggggtttggtattaccgtaggtaatgcattacgccgtatcctgctctcttcattagagggttttgctatcactactatcagaatagatggtgtggagcatgaattttctagtgtacctggagtaaaagaggatgttaccaacattatcttgaatctgaaacaagtgagattcaagcaagtagttgaagaattcgagagcgaaaaagtgagcatcactgtcgagaattcaagtgaatttaaagcaggtgacataggtaagtatttgactggatttgaagtgttaaatccggaattagttatttgtcatttagattctaaggcaactatgcagattgatattacaattaacaagggtcgtggatatgttcctgctgatgaaaatcgcgaatattgcacggatgttaatgtaattccaatcgactctatttatacaccgatacgtaatgtcaagtatgctgtagaaaacttccgtgtagaacagaagactgactacgaaaagctagtgcttgagattagtaccgacggttctatacacccgaaggaagcgctgaaagaagctgcaaaaattctgatctaccacttcatgttgttctctgatgagaagatcacgcttgaaagtaacgatactgatggcaatgaagagtttgacgaagaagtattgcatatgcgtcaactgttgaagactaagcttgttgatatggacttgtcagttcgtgccctcaactgtttgaaggctgctgatgtagaaactctcggcgacttggtacaattcaacaaaactgacctgttgaagttcagaaacttcggaaagaaatcgcttaccgagcttgatgatttgctggaaagtctgaatctatcgtttggaaccgacatttctaaatataaattagataaagaataaaaaatgagacataataaaaaattcaatcatttaggtcgtactgcttctcacagaagcgctatgttatctaacatggcttgctccttgatcaagcacaaaagaatcactacgactgtggcaaaggcaaaagctttgaagaagtttgttgagcctttgattacaaagtctaaagaagatactacgaattctcgtcgtgttgtatttagcaacctgcaagataagattgcagtaacagaattgttcaaagaaatctcggttaagattgctgaccgtccgggtggttatactcgtatcatcaagactggtaaccgtttaggtgataatgcagaaatgtgtttcattgagttggttgactacaatgaaaacatggctaaagaaaaagttgctaagaaagctactcgtactcgtcgttctaagaagagtgccgaagctgctgctcctgctgcagttgaagctcctgcaactgaagaaccaaaagctgaatcagctgaataattttacagttattcttatacatataaaaaaggctactcatacgggtagccttttttgtatccttatgttttagttatcctaagatacattaaaagatttaccgaatgaacttttcataagaattatctgttatatttgcaggagaatatggcaaaatttgtaaaggtaatattgtttctgttgctggcggttgcccttcatggggtcgcaggcaatgttttcactgaaaagcaggtggaacaaccagagcatgctgttacatattctatgaaaccgcaggggcagattaatgctccagaatctccttatcttcctgtggctgaattaactaatttgcaaagccatcagatatcggtgacacgcatccaacgtgtgcaaatcggtgaatacttctcttctctgagaaatgtgctgcaatgttgtgcagaccgtgataactcgctgtcacagcattggggaaggatttataatactacaacttcctattattgccagcctgcaagtgaatattatgtatttactttaaggcatattattatttagacgtttatttattggtattattttacggattgctggcgttaattatatagtgccggtcagtctttattatcttcatatttttactaataatttaaacttcaatattatggcaactcaagctattgatgctactatatttgcatcttcacatcccgatatcgctaaacgtacgagtatctccggtcttttaatttcttgtgtaatgttactgattggtattttatcttttgcttctacttttgaactggaagataaatcgtctactgtcagtatggctctgatggtctttggaacaggattgttccttttaggtatattccggcttttctggaagtcaaaagaagtggtctatgtaccgacaggaagcatagcgaaagagcgtagtattttctttgatctgaagcatatggacaagttgactgaccttgttaattccggttcattttctgcggattcaaagataaagagtgaggcaagtggtaatatacgtatggacgtgatactatctgctgataataaatttgcagctgtacagctattccagtttgtaccttatacatatcagccggtgactgctgtgcattattttaccaatgatgcagctgcagctgttgctgcgtttctgactaaaagtcaattgaattaaagtgcttaatgccaaatggtattcatgttgatggcgaattgtcattcatcagaagatcatttctaagatagtcaagtgcagggatgcagggataaatggataatggattgataattactgaatatcgcacttctatgtcttaatagcttagatacaagcaggctttaaggaataatttgacatgtggggattaaccgtcgatgacggcaatccccatttttttcattaagaagcacgcattcatgttctgtgcgactccgcttctcatctggtatgaaaatgtcagttcgttgttggtaatgtccgcttcgaaacaataattccggatattttgtggaaaagcatctattagtgtgcctagcagtaggtcatgagtagcgataataccattggcatccatgctcatgaactgtttgattaaggcaaaagaacctttctgtttatccatagagttagttcctttcagaatttcatcaaggatgataaataattcttctccggctttgagtttatcaatgattagtttcagtcgtttgagttcggcgaagaagtaagattcgttgtcggtgagtgaatcacttgtccggaggctggtgacaagacgagcgggaaatatttccattttcgcagcccatacaggagcaccaatgcaagccaagaggtagttgacacctacggtgcgcaggtaagtacttttgcctgccatgttggcgccggtaataatgataaagaacgggcgtttctccatatcgattccattgcggacacatttattgcggtccatgagcggatgccctaaggcttcggcttgcagatggaaagactgagaagttatttgaggatagatgtaatccggatggttgtatgagaatgttgcaagagaacaataagcatcaattgctccgatagcttcgatccagcggggaagatctgcggagtgtgcttctttccatttctcgatttgcatgacttggcggagttcccaaaataggaggccgttcaagatggtgctcattagcagattacctcgctggtcgagtgcattcatgagtttagcaaggcgatgtacggactgggaagctgtttgattttggcttgtaagttcggctttcagttgttgcaatgcagggctgtgcatctcttttttctcggtgatgagaatctggtcggcgtaagtagacagaatttgtagtttttcgccatacgtcgcttgtattttggttattccttttgagaagataaaactgaatacgacaaagcatgcaaatactatcccgctgatgcttgcagggagaaatcccagtatcgttgcgccgatacacaggaggtttataatacctactgctgtcgggaggatacggaggaaagcgtgtttccgatagtcgctcggactgtttacccattctttaattgcagaggtgtcggatggcttgcctttataaagtaatccgagcaggcggaattgttgtcgaaactcaagttctgaagatagttcccgaatcgcttcctgacgttgttcgatagcttctttttcttccagatgtgcattgaaccagttggcaagacgctgtttgccgatgggggtcgaagtacgattgatatactggaatagtgagtgctcgccaaatatgtccaagtcgaaagtatagaggtgagacggatcgatgtattcctttccgttgtcgaagtcggaaaagtcatattgcagtgctcgtagttcctgctgattgatttctattttctttttgagataatctttccagtaaaaccatcggttgtggctttgcaccagccaaatgaaagcgatgatgggaattacggtaaagacgatgagctttaaccatccatcagaccaaaaaataatagcggaggctactgcttctacgaataagatcagtctcagaaggctgatatagcgaatgcgtttccgcgctttttgtagttgttgttctgtttcctgaatgatttgttgataggttgctataatattttcttgtttttccatacgattatattgcttttcggacaaaggtaatataattcgtaaaaggcagaatgggagcgtgtttttgtaaagagcagatttactctttattaacggtcattcagtaatcggtgatgaagcaagttgtgatggtttagagcaaagttacataggaaataaacacactttgttattgtcacttgtcacctttgcgtgataagtgtcttataattagtcaagtaatggtgataataaccggtgataataaggtgataatagatgtttttctgctttttattatcacctgtttttaatagataatacgattaatttgctgattatcagtggtaagtgcactgttttaaagcctttgcctatttatgttaagaactcccttttaggcatgaatgtacgttgtttataccatatattacttcctgtatgccgcctatattaagacaagactcggcaaccttaacctgtaaacaaggtttgactaatatattttgttcgtttcatattttcgtttcacgtccgtgatctgttcggttcacgtatgtgagctcaatagtttacgtacgtggactgatgggagcatgtacgtgaaacgatttattgttactgacggaatatattaatcatgcctgcataatagcataatgaatcgttcatttgctgttgttcccgggagcttattctttcatagttgatatggggctgactaaaaagtcggtagtatcttaaatcttctccttcccgaagggaggggaattggagatactaccgactttttagtcaaccccgactcaggtattaacgcttgatataccagataaaacacctgatattccagatgaaaaaagacaagataagattataaaaagaaccataaaccgtatttcatgagtaaacaaacttcgggggcgattgacttgcttccgggataattgcgtgtaagaggtgctgtgccaagaaggcgaaaggggcttcttggcttcttttttcaacatttctttttccattcttgcatttatgcgctaaaatttataactttccactcgaaaaggcgttgaatgaagaaaggaggatggcttatgaagaaaggatatattttgtggttgctgataagcgtgattagccttccggtagttgcgcagaatatcatttattcaaacttgaaggagttgatggctcaagatggcgatacccttgcagtgttgcgagtagagaagcgttccagaagccagattctattgacaggcggggctgactaccggataacggcaggcaatgatgaatctatgtgccgccagttgaagaagcgttgttttgcggtgcgtacttctgaaggagacttatttatcaactgtcgtaagttgcgttataaaaagatgcgtttcggggcgtggtatgctccggctgttcagttgggcaaaaatatctatttctgtgcgatgccattagggtcggtaattggtgggacatttgcagaagaagatgatgtgaaactgggcggaaatgtgggagatgctcttgctgcttcaagtctggttactaaacgggtctgctatgagctgaacggtgagaccggaaagattgattttgtaggaaaagaaaagatggcgcaactgctggaaaaacatccggaatggaaaaaagcctaccttacaaaagacagtcaggaagcgaagcataccttcaagtatctgcaaatgctgtgtggtgagcagcagaaagaataaataatacctttctgataataaatctaccaaaacctttgtcttttctcttctttttttctatattgcgaagagttatagaactgtattgcttacagtttgtaatccttaattctgcttattatgaagataactcttggcaacacgttacctccctacccagctttcatagaaggtatccggagggcccccgaccgtagttatacgcttacgccggcgcagacagctacggcattgaagaatgcattgcgctatatccccttggaattgcatgagcaactggcacctgaatttatggaagaattgcgtacccgtgggcgaatttacggataccgcttccgtcccgcaggcgatctgaaagccaggccgattgatgaatatcgtggcaaatgtgtggaaggcaaagcctttcaagtaatgattgacaacaatctctgttttgatatcgcgttgtatccctatgaacttgttacttatggtgaaaccggccaagtttgtcagaactggatgcaatacctcctgatcaagcaatatctcgaagaacttactcctgagcgaacactggtcattgagtccggacatccgttgggactgtttcgttcccgtcccgatgctccccgcgttattattaccaactctatgatgataggtcagttcgacaatcagcacgactggcacattgccgcacaaatgggagttgccaactatgggcagatgacggcgggcggctggatgtatatcggtccgcagggtattgttcatggcactttcaatacattactcaatgccggacgattgaaactcggcattccgcaggacaaagatttgcgtggtcacctcttcgtatcttccggtttgggaggaatgagcggggcacagccaaaggcagccgaaatagccggagcagcctctattatagccgaagtcgatagctcccgtatcgaaacacgttatcggcagggatgggtaggccatgtcacacaggacctgtcggaagctttccgcctggcaaaagaagcaatggaacgtcgggaaccttgttcgatagcctatcatggtaacgtcgtcgatttgctggaatatgcggaacgcgagcagattcatattgaacttttgtccgatcagacctcttgtcatgccgtttacgaaggaggctactgtcccgcaggcttgactttcgaagagcggacccgccttcttcatgaatctcctgatcaattccgtcgtctggcagacgcttctttgcgccgccattttgaggtaatccggaaactggtggcacgcggcacttacttcttcgattatggcaactcctttatgaaagcgatttatgatgccggagtgaaagagatttcccgcaatggagttgatgagaaagatggatttatatggccgagttatgtagaagatatcatgggaccccaactctttgattatggctatggccccttccgatgggtatgtctgagcggtaggcacgaagatctgataaaaacggaccgtgccgcaatggagtgcattgatgtcaatcgacggggacaggatctggataattataactggatacgcgacgccgaaaagaacaggctggtagtaggtactcaggcacgtattctctatcaggatgctgtaggaagaatgaatatcgccctccgtttcaatgaaatggtacggcggggagaagtaggaccgatcatgttgggccgcgatcatcatgatgtgagtggaaccgattcgcctttccgtgagacatcgaatatcaaagacggaagtaatgtcatggctgatatggccgtgcagtgttttgccggaaactgcgcccgtggcatgagcttggtagccctgcataatggcggcggagtcggcatcggaaaagcgattaatggcggcttcggcatggtatgtgacggcagcgaacgggtagacgagatacttcgctcggctatgctttgggatgtgatgggcggagtggcccgccgttcgtgggcccgcaatccgcatgcaatggaaactagtgacgctttcaatgaatcacattcggaagggtatcatataacgatgccttatctggctgatgacgagctgattaaaaagacaataaaagaagcattgtaatagaaagtaacgaaatagagaaataaatatgaattggagtaagatcatcgaatgtgtccccaactttagcgagggacgtgatttggagaaaatagacaagatagtagccccttttcgtggcaaatccggcgtgaagctgctcgattatagcaatgatgaagatcataaccgtctggtagtcactttggttggcgaaccggaagccttgcgcgatgcagtcattgaagctatcggcattgctgtccgtctgatagaccttaatcatcatagcggacagcatccccgcatgggagcggtggacgtggttcctttcattccgatcaagaatacgacgatggaagaagccgtcgccctgtcgaaagaagtggcttcccgggtggcggaactatataatctccctgtctttctgtatgaaaagtccgccacagccccgcatcgggaaaatctggcctccgtccgtaagggagaatttgaaggaatggcggagaaaatcagacttcccgaatggcagcccgacttcggccctgccgagcgtcatcccactgccggaacggtagctatcggtgcccgaatgccgctagtcgcttataacatcaatctgagtaccaataatcttgaaatagccacgaagatagcaaaaaatatccggcatatcaacggcggtctccgctacgtcaaagcaatgggggtggaactgaaagagcggaatatcacccaagtatccattaatatgaccgattacacccgcaccgccctttaccgtgctttcgaattggtgcgtattgaggcccgccgctatggagtgacgattgttggaagtgagatcattggtctggtgccgatggaagcgctgatagatacggcctcctattatttaggactggagaatttctccatgcagcaggtgctggaagcgcgtatcatggaatagcgcccggagtattaaaataatgtgcgtccgatataaagctgctgaaacttatatcgaattatgattgaaatagtaagaaccgaataataaaagatcaatgagtgaaaacctgattatattcaatgcccgtattgtcaccccgacaggaatctccgcccgtaaaggtgcggaaatgagacaactccgcatcatagaaaacggaacggtagaagtgaccaaaggcatcatcacttacgtcggcgagagtcgtggcgaagatcgtgacggctactaccagcattactggcattacaacgcccggggacattgcctgcttccgggctttgtcgattcgcatacccattttgtttttggcggagaacgttccgaagaattttcatggcggctgaaaggcgaaagctatatgtccatcatggaacgtggcggagggatagccagtaccgtaaaagctacccggcaaatgaatttcctgaaacttcgctcggcagccgaaggctttctgaagaagatgagtgctatgggggtcaccacggtagaaggtaaaagcggctatggacttgatcgggaaacagaactgctgcaactgaaaataatgcgcagcctgaacaatgacgagcacaaacgtatcgacattgtatccactttcttaggagcccacgcccttcccgaagagtataaaggaagaggagacgaatacatcgactttctgattcgtgaaatgctccccgttatccgcgagaacggacttgccgaatgttgcgatgtcttttgcgaacaaggagttttctctgtcgaacagtcccgccgcctccttcaggcagccaaagaacaaggcttcctattaaagctccatgccgatgaaatcgtttcctttggtggcgctgagctggctgccgaactgggcgctttgtctgccgatcatctgcttcaggcttccgatgccggaatccgtgcaatggccgacgcaggagtagtagctaccctgctgcctctgacggctttcgcactgaaagaaccttatgcacgcggtcgtgaaatgattgatgccggctgtgccgtggcacttgccacagacttgaatccgggaagctgtttctccggttccatcccgttgaccattgctttggcgtgtatttacatgaaacttagcatcgaagaaaccatcactgcccttacactgaacggagctgctgcccttcatcgggcagaccggatcggaagtatcgaagtaggcaagcaaggtgactttgtcatactgaattcggacaattatcacattctgccatactacgtaggcatgaactgtgtcatcatgactattaaaggcggtatgctataccccgtcaattgataactaaaagcataaaataccatgttagcagatttaaccgtaaaagatttcttagataaggtagccggcaatgatccggtacccggcggtggcagtattgccgctttaggtggagcgctggcttccgctttggctacgatggtgacaggactcaccatcggcaagaaaggatatgaagccagcgaagaagtaatgcagcacgcacagacgcttaccacccgattccaaaaagaattcatcgccttgattgataaagactccgaagcctatgatgaagtttttgcctgttttaaatttcccaaagctaccgatgaagaaaaagctgtccgtagcgctgccattcaggaagccaccaggcatgccgccctcattccgatggaagttgcccgaaaagcacttgaagtgatgcccgtcatagcagacatcgcccgtctgggaaaccggaacgctattacagacgcctgtgtagccatgatggcggcacgatccgccgtattgggggcattgctgaatgtccgcattaatctgggggtactcaaagacaaagaatttgtccagggcttgcaagccgaagcggaccggatagagcaaaccgcttgccggaaagagaaagaattactggatgccgtcaaccaagatttacgcgtatgagcaagaatgtgtatcaaataggttccggagaactgaccttcgaaatcatcgaacggatcatcaacgagaatctgaagctggaactggctcccgaagccaagctccgcattcagaaatgccgtgattatctagaccataaaatagcttcttccgaagaacctctttatggcatcaccactggcttcggctcattatgcactaaaaatatttcttccggcgaattgggaaccttgcaggaaaacctgataaagagccatgcctgcagtgtaggcgaagaaatccgtcctgtcatcatcaaactgatgatgttactcaaagcccacgctctctcgttgggacatagcggcgtgcaactaatcaccgtacagcgtatcctcgactttttcaataacgacgtactgcccatcgtctatgatcgcggttccttgggagcttccggcgatctcgccccattagccaatctgttccttcctttgatcggtgtgggcgacgtcaactataaaggaaagaaatgcgaagcaatcagcgtgctcgacgaatttggctgggaacccgtccggctcatgagcaaggaagggcttgcactgctcaacggtacccagttcatgagtgccaacggtgtatttgccattctcaaagccttccgcctttccaagaaagccgacctgatagctgctctttctcttgaagccttcgacggacgcatcgacccgtttatggattgcatccagcagatacgccctcatcccggacagatcgagacaggagaagctttccgtaaactgctggcaggcagcgaactgatcgaacgtcccaaggcgcacgtacaggatccttactctttccgttgcatcccgcaagtgcatggtgctacgaaagacgctatccgctatgtttcctccgtactgctgaccgaaatcaattccgtcacggacaatccaacgatcttccctgacgaagacagaatcatttccggtggaaatttccacggtcagccgttggctatctcctatgactttctcgctattgccttggcagaactgggaaacatttccgaacgccgtgtctctcaattgattatgggacttcgcgaacttccggagtttttggtagccaatccgggactgaattccggttttatgattccccaatacgctgctgcgtctatggtcagccagaataaaatgtactgctatgccgcatcgagcgattccatcgtttcgtccaacgggcaggaagatcatgtaagtatgggagccaatgccgcaaccaaactttataaagtgatggacaaccttgaacatatccttgccatcgaactgatgaatgctgcgcagggcatcgatttccgccgtccgctgaaaacgtctccgctgctggagagtttcctgcatgcctaccggaaagaagtgccttttgtgaaagatgacatcgtgatgtataaagaaatacataaaacagtcgcttttttaaaaaggactaagttagagtactaaacctcctttttcgcttttcgttaataatggtgactgttattgccggataaacgatcgattcttatcggtatttatccggcatttgccgattattctccctcttacagcgataaaactttacttcatatacctctattccttacttttgctctatatttcctcttaacacttgttttcatatacctctaatgaatgataatatttatcaaatgggctataaataaaaggaaacttgatttgttaattgagttttctatatatctttgttccgtttttcgctttaaatggtgaatttatagaaaactgagtctaacaaaatctaaaaagagtgatgatggagcatggaagagacgcgtcccaaaaggcggagctgagagaacggattataatgaccgcgacagaagcttttactttgaaaggtatcaagtgtattacgatggatgacattgcggcagcattgggcatttccaaacgtacgctctatgaggtttttgcagataaggaatcattattgaaagagtgtattctgcaaaagcaagctgaaagagacaaatacttgcaggagatatacgagcaatccaacaatgtgctggaggtgatacttgctgtctttcagaaaagcatcgagatctttcatcagaccaacaagcgcttcttcgaggatataaagaaatatccgaaggtatatgcgatgatgaaagaccgtagtgaaagtgactcggagaagacgatgtctttctttaagtcgggggtagagcaaggtatctttcgggcggatgtcaactttgagatagtcaatctgttggtgcgcgagcagtttgatgtgctgctgaatacggacatttgcaacgaatatccttttatagaagtatatgaatccatcatgtttacctatatacgtggcatttccacggaaaaaggagccaaagttttagaggaatttatatcagaatatcgtaaaaaccgggtcgagcaacaataggagctaggttcggatgacaaacaattaaggatcaaatagaaacgagtttatgaacagattgaaaagattgacaggcaagaaaatgcttctgacggcaatggctctctgtgcgtttggctttgcaaaggctcagacggagcagacaacgcagaatacgctgacattgacgctggacaaagccctggaaatagcgttggatgagaatcctacgataaaggtggcggcagaagaaattgccttaaagaaagttgcaagtaaggaagcgtggcagagcctgttacccgaagcaagcctaaacggatcactggatcacacgatcaaagcggctgaaatgaaactgaacgatatgtcgttcaagatggggcaggatggtacgaataccgccaatgccggactgagcattaacctgcctttgtttgcaccggcagtctaccgggccatgtcaatgacaaagacggatatcgaactggcagtggagaagtcgcgtgcttccgaactggatttgatcaatcaggtaaccaaggcttattatcagctgatgcttgcacaagatagttatgaagtgcttcaaggcagctataagttggcagaagataatttcaatgtcgtgaacgccaaatatcaacaaggtgcagtcagcgaatttgacaagatcagcgcagaagtacagatgcgcagcatcaagccgaatgtcatttctgccgccaatgccgtgacgctggcaaaactccagttgaaagtgttgatgggcattacggctgatgtggatattaagactgacgataatctgacaaactacgaatcaatgctgtttgccaatcagttgaaagaagaagatatgagtctggagaacaatacaacgatgaagcagttcgagctgaatatgaaattgctcgaaaagaacgtgaagtcgctgaaaacgaacttcatgcctactttgtcgatgagcttctcttatcaatatcagtctttgtataatccgaacatcaatttctttgattatacgtggagcaacagttcgtctttgatgttcaatctgagcattcctttgtatagggcgagcaactttacgaaggtaaaatcggcccgcatccagatgcgccagcttgactggaaccgtatcgatacggagagaaaactgaatatgcaggtagtcagctaccgtaacaatatgactgccagttccgagcaggtggtcagcaacaaagaaaacgtgatgcaggctgaaaaagcggtacagattgccggaaaacgttatgaggtaggtaagggaaccgtgctcgaacttaacagttcgcaggtatcactgacgcaggcacaactgacttacaatcaatcaatctacgattacctggtatctaaggctgaccttgatcaggttttgggaaaacaataaagatagacaactaaaattacaactaaggaatatgaaaaaaggtatccaattagtggctctgctattgacagtagtaatgagctcatgtacgggtggaaaagataaggctgctgtgaaacaggaagacgagaagcccagagtaaaagtggctgatgtaacagcccgtcccgtagatcagatacaggattatacagcgacggtagaagctgaagtaaagaacaacattgctccttcgtcacctgtccgcatcgaccggattctggtagaagtgggcgaccgtgtatccaaaggccagaagctggtgcagatggatgcagccaacctcacacagacgaaactgcaactggacaatcagaaaattgaatttaatcgtatcgacgaactttataaggtaggcggtgcttccaaatcagagtgggatgctgcgaagatgcagctcgatgtgaagcaaactgcttatgataatctggtagagaatacgtttctgttgagcccgatcaacggagtaatcactgcccgtaattacgataatggtgatatgtatagtggcggaagtccggtgctggtagtagagcagatcactccggtcaagctgatgatcaatgtgtctgaaacctacttcacgaaggtgaagaaaggcgaaccggtagatgtgaagctggatgtatatggcgacgaactgttcaagggaactatcagcctgatctatccgactatcgacgcaactacccgtactttccaaatcgagatcaagttggacaacaaagatcagcgtgtacgtccgggaatgtttgcccgtgctaccttgaacttcggtacggcggacaacgtcgtagtacccgacttggctattgtgaaacaggcaggttccggcgatcgctatgtgtacgtttataaagatggtaaagtgtcctacaacaaagtggagttaggcagacgcatgggctcggagtatgagctgaaatccggtgtgcccgataactcgcaggtggtagtggccggacaggcacgtctgataaacggtacggaagtagagatcgagaagtaaaatcactattaaactaatcactataaagaaatgagtttatacgaaggtgcggttaagaaaccgattatgacctccctctgctttctggcagtggtgatttttggtcttttctctttgtccaagttacctatcgacttgtatccggacatcgatacaaatacgatcatggtaatgaccgcatatcctggcgcaagtgcttcggatatagaaaataacgttacccggccgctggagaataccttgaatgcggtgagtaacctgaaacatattacctctcgttcttccgagaatatgtcattgattacattggagtttgagtttggtaatgatattgacgtgctgacgaatgatgtacgtgacaaactcgacatggtaagctcacagctgccggatgatgtcgagaatccgatcatcttcaagttcagtacggacatgattccgattgtattgctttcggtacaggccaatgagagccaggccgcgctttacaagatactggacgaccgtgtggttaacccgttggcacgtattcccggtgtgggaacggtgtctatcagtggtgcgccgcagcgtgagattcaggtatattgcgaccctaacaaactggaagcttataacctgagcattgaaactatcagctctattatcggagccgaaaacaagaatattccgggcggtaacttcgatatcggtagtgagacgtatgccctccgtgtggaaggggagtttgatgattcccgtcagttggcagatatcgtagtaggtacgcacaatggagcgaatgtcttcctgcgtgatgtggcccgcatcgtggatacggtggaagagcgtgcgcaggaaacctataataacggtgtgcagggtgcgatgattgtggttcagaagcagtcgggcgccaactctgtagaaatttcccgtaaggtagaggaagcgcttccgcgtttgcagaagaacctgccgagtgatgtgaagctgggagtgattgtcgatacttccgataatattttgaatacgattgacagtttggcagagactgtaatgtatgccttgctgttcgttgtgatcgtcgtgttcctgttcctgggacgctggcgtgcgacattgattatctgtatcacgattccgctttcgttgatcgcctcctttatctatctggcgattaccggaaatacgatcaatattatctcactgtcgtctctgtctattgccatcggtatggtggtggatgacgcgattgtggtacttgaaaacgtgacgacacatattgagcgtggctcggacccgaaacaggcagcagtacatggaacgaatgaggtggctatttccgtaatcgcttctacgctgaccatgatcgccgtgttcttcccgttgaccatggtaagcggtatgtccggtgtgctcttcaaacagctgggctggatgatgtgtgccatcatgtttgtgtctaccgtcgcggctctgtcactgaccccgatgctctgttcgcaattacttcgcctgcagaagcgcccgtcgaagatgttcaagctcttctttactccgatagagaaagcgttggacgcactcgatacaggttatgcgaaaatgctgaactgggcagttcgtcatcgtccggttgtgattgtgggatgtattgctttcttcgttgtcagcttgctgtgtgcgaaaggaatcggtacggagttcttccctgcacaggacaatgcccgtattgctgttcagcttgaattgccgatcggtacacgaaaagagattgctcaggaactttccgagaagctgactaaccagtggctgacgaagtataaagatatcatgaaggtatgtaactataccgtaggtcaggcggactcggataatacgtgggcttccatgcaggacaacggctcgcacattatttccttcaacatcagtctggtagacccgggagatcgtgatatctcactggaagcagtctgtgacgagatgcgtcaggacttgaaaggttatccggagttcagcaaggcacaggttattctgggaggtagtaatacaggtatgtctgctcaggcaagtgccgactttgagatatacggatacgatatgacgatgactgatagcgtagcagcccgtttgaaacgtgagttgctgaccgtgaaaggggtgaccgaggtgaacatcagccgtagtgactaccagcccgagtatcaggttgatttcgaccgtgagaagctggcgatgcacggactgaacctggctacagccggtaactacttgcgtaatcgtatcaatggtgccgttgcttccaaatatcgtgaagacggggatgagtatgatatcaaagtgcgctatgcacccgaatatcgtacaagtctggaaagcatcgagaacatccttatttataatgccaaaggcgagtccgtgcgtgtaaaagatgtcggaaaggtagtcgaacgttttgcgcctcctaccattgagcgtaaagaccgtgaacgtatcgtgaccgtatccgccgttatctccggtgctccgttgggtgacgtagtggcagcaggtaacaagcttattgataagatggatattccgggagaaatcacgattcagatttccggttcgtatgaagaccagcaggattcgttccgcgacttgggaacattgggtatcctgattgttatccttgtattcatcgtaatggcggcacagttcgagtctctgacttatccgttcattatcatgttctctctgccgtttgcatttagtggagtcttgatggcgttgttctttacgggcagtacgctgagtgtaatgagtttgctgggaggtatcatgctgatcggtattgtggtgaagaacggtattgtgctcatcgactacatcacgctctgtcgagagcggggtatggcggtcatcaactctgtggtgacatctggtaagagccgtctccgtccggtattgatgacaacagctactaccgttctgggtatgatcccgatggctatcggtggcggacaaggttctgagatgtggagtccgatggcgattgccgtaatcggtggtctgacggtatctactgtgttgacactcgtcctgattcctacgctgtactgtgtatttgccggaacaggtatcaagaacagacgtcgtaaactccatcgcaaacgcgaactggatgtctacttccaggaacataaagatgaaattattaagaaataacagaaaagaaatatgaaatcagtattgataacattcgatcaggcgtattacgaacggatcatggcattgctcgaccgtctgaactgccgtggctttacataccttgaaaaggtgcagggacgtggctcaaagacaggcgatccgcacttcggtagtcatgcctggcccagtatgtgttcggctatccttacggtggtcgatgacaataaagtcgatccgttgctggatacactgcataagatggacttgcagaccgaacagctgggattacgtgcatttgtatggaatattgaacggaccatctagcgttcgaacagtgaataaataatcggaagggagaatctataaataatgtagattctcccttcttttttcttgcttttccctatctttgcagcctgaaaacgtccggcaccgatgaacttgtggtccggcaccgatgaggccttccttcggcaccgatgaggaggtggctcggcaccgggtaaaaaacgaggactcaatgagtgcttatatctacttataagatggagattatcaagaactacctgaaatattcgttatggcttgtactgatcgtgtttgcagcactctttgggttgcactggcttccggctataacgatcgacggacacacgatgaggcgtgtcgatcttttaagcgatcttcgctatccgaagcaggaagtggcggtagccgattcggataccattcctttgcctcctgtcgtaaagccggtttttgtcgatacttgtcgtgcgggcatgacttgcattgaagattacggtgactctacccgtcgcggtatggcttctttttatgaagcgctcgaccgtacttcttcttcacatccggatcatgacgggctggtacgtatcgccgttttcggtgattcatttatagaggcggatatctttacggctgatttacgtgaaatgcttcagaagcggtttggcggttgcggtgtcggatttgtcacaataacttcgatgacgagcgggtatcgtcctaccgtgcggcatactttcggcgggtggtccagtcatgcggtgacggacagtgtgtatttcgataaaaagaaacagggtatttccggacattactttattccccgtgaaggagcatacgttgagttgagggggcaaagcaaatatgcttcgctgcttgatacctgtcagcaggcttcgattttcttctataataaagattccgttcatcttactgcccgtgtgaatcggggggagagtaagaattattccttagcgccttcgggcgatttgcagaagatttccgttgaaggacgcatcggctctgtccggtggacggtagatcgtgccgattctacgttgttctatggcttggcgatggatggtaagaaaggaatcattcttgataatttctccttgcgaggcagttccggcttatcgttgcgggggattccgcaacaaatgctgcgtcagtttaacgagcagcgtccttatgatctgattattcttgaatacggattgaatgtggctaccgaacggggacgcaattatgataattatcagaagggactgctcacttctatcgaacatctgaagaattgttttccacaggcgagtattttgctgttaagcgtcggcgaccgtgattataagacagaagatggtgaacttcgtaccatgccgggagtcaagaatctgattcgctatcagcagaacattgctgccgaaagcggtatcgctttctggaatatgtttgaagcgatgggaggcgaaggcagtatggcgaacctcgtacacgccaaaccttcgatggcgaactacgattatactcatatcaacttccggggaggcaaacatctggcaggactgctctatgaaacattgatatatggtaaggaacaatatgacaggaggcgtgcttatgagcaagaataacctgttgctgggctttatcttgggactgatggcaacattctttcttctttcggcaggaaaggcgcaagaccgtatccctgcctgtcctccactggggaagaccttgaaaatgataaaacctttgcgggaaatgaactgggcgaatgataccatcgccgtgcagacttcttttccttccgctttccgcgaaaccggaaggaatgagataatcgacagcattgccctgctgacacccgtatttgaacgtctccgtcaggtacgtgccggactttccgaagatacggtgcgtattctccatatcggagacagtcacgtacgcgggcacatctatccgcagactacgggaacgctgctgaaagaaacctttggtgctgtctcttataccgatatgggggtgaacggggctacctgtctgacgtttacccatccgggacgtattgccgatattgcagccatgaagccggaactgctgattctgtccttcggaaccaacgaaagccataaccggcggtataacgtcaacctgcattataatcagatggacgaacttgtcaaactgttgcgcgacagccttcccgatgtccctattcttctcaccacgcctccgggttcttacgaaagtttccggcaaaggcggcggaaacgtacgtacgccatcaatccccggacggttacagcggcagaaacaattcgccgttatgccaaagatcatcgtctgctcgtgtgggatatgtacgatgtagtagggggcaagcgccgtgcctgtaccaactggacggaagcgaaactgatgcgtcccgatcatgtgcattatttacctgagggatatatcctgcaaggaaatttattataccaagccattattcaagcttataacgattatgtttcccattgatattgatttcagccggttaaaagaggtgcttacctacgatccgcaggcaccgatgatattcagcagtggtatcttcctttggctgtttgccgcctttatgatcgtatacaccttgttgcagcgtaagtatacggcccgtattctgtttgtgacgcttttctcttattacttttattataagagcagcggcacttactttttcctgctggcgctggtcacggtttgcgacttcctgctggcgcaatggatggaccgtaccgaaggacgctggaaacgcaaagggttggtgactctgagtttgggagtcaatctgggacttcttgcttacttcaaatataccaattttttgggaggagtgattgcctcgttgatgggaggagaatttacggcgcttgatatattcctgcccgtaggtatctcattcttcactttccagtcattaagctataccattgacgtttaccggaaagacatcaagccattgaccaacatactggattacgcgttttatgtatccttctttccgcagctggtggccggaccgattgtgcgtgcccgtgactttattccgcaaatccggaaaccgcttttcgtttctcaggagatgttcgggcgggggattttccttattctctccggtttgttcaagaaagcaatcatttccgattatatcagtgtcaacttcgtggagcgtatctttgataatccgaccctttattccggtctcgagaatctgatgggagtatacgggtatgctttgcagatttactgtgacttctccggatatagcgatatggctatcggtatcgctctgctgttgggctttcattttaatctcaactttaattctccttataagtccgcctccattactgaattttggcggcgttggcatatctcattgtccagttggttgcgcgattacttgtacatatccttgggaggaaaccggaaaggtaagttccgccagtatctgaatctgattattaccatgtttctgggtggattgtggcacggagcttcctggaactttgtactttggggaacatttcacggcatcgctttggcggtgcataagatgtggatgtccatcataggtcgtaagaaaggagaacaaagtcatggctggcgtcgtgtattcggagtcattatcactttccactttgtctgtttctgctggatattcttccgtaatgccgattttcagaactcgatggatatgttgagacagatattcaccactttccgtccgcagcttttcccgcagttgatcgaaggctactggcgcgtgtttgctttgatgctgctcggctttctgcttcatttcactccggatagttgggaaaatgctgcttgccgtggagttattcgcttgccgttcttagggaaagctctgctgatggtggctctgatttatctggtcattcagatgaagagttcggagattcagccgtttatttatttccagttttagctttctttccacactgttttgaattaaatgatagtcaatagtatcttaattctcctccttcccgaaggaggagaatggagatactaccgacttttgggcatccccaatggagatactactgtttgattcatttttaaacagttgtgaacaaatctctatgcaatctgtattttagtctatggacgtgtgtggtattttgcgctagctttgccacgaacagataaatagacgtactatgagatatagaatcctctttttctttttggcttttatcggaataagccagttcgtgacatcgtctgatgtccgtaataaatataatttcaattcagactggttgctttatgtgggcgatgttcccgaggcaaagcagccgcgtttttctgattcggagtggaagaaagtgactttaccgcatgccttcaatgaagatgaggctttccgcctgagcattgatgaactgaccgatacgattatgtggtatcggaaacatttccgtctgcctgccgacagcaagaataagaaagtttttgtagagtttgaaggagtccgtcaaggggcggatttctatataaatggtcagaatgtcggcctgcacgagaatggtgtcatggctgtcggttttgatctgactccttatattaagtacggacaggaaaatgtaatcgcagtccgcatcgacaatgactggaattataaagaacgggcgacgggcacgaaataccagtggagcaataagaactttaatgccaattatggcggtatccccaaaaatgtatggctgcacgtcaccgaccgtctgtatcagactttacctttatatagtaatctcaaaacgaccggagtctacatctatgccgaagacatccgtgtgaaatcgcgcaaggccattattcatgcggaatctgaaatcagaaacgaatataaccgtgataagcaggtttcctatcaagtagaactgatagaccgtgatggtacatcgatccaaacattcgaaggaacaaaggcggtagtgaaaccgggtgaaacaatcacgctgaaagcggtatccgaagtggataacctgcatttctggagctggggatatggctatctgtatacagtaaagacaagcctgtgggtagatggcaggaaagtggacgaagttgccacccgcaccggattccgtaaaacgcgcttcggtaaaggaatgatctggctgaatgaccgtgtcattcagatgaagggctttgcccagcggacaagcaatgaatggccgggagtcgggatgagcgtacctgcctggctgagcgattatagcaatcatctgatggtggagggcaatgcgaacctcgtgcgttggatgcatgtcactccgtggaaacaggatatcgagtcgtgcgaccgtgtgggattgattcaggctatgcaggcgggagatgccgaaaaagattgtgaaggacgtcagtgggaacagcgtacggaattgatgcgcgacgccatcatctataaccgtaataatccgagtatcttattttatgaatgcggcaatgagtccatcagtcgtgaacacatgattgagatgaaagtgatacgtgatttgtacgatcctcacggcggccgtgcaatcggttcccgtgaaatgctggacatccgcgaagcggaatatggaggcgaaatgctgtatatcaataagagtgcgcatcatccgatgtgggcaatggagtattgccgtgacgagggattgcgcaaatactgggatgattattcctatccttatcacaaggatggagacggcagcaattcttataagtccaccgttaccaacaaagtacagaagaaagtggatgcccgtgtctacaaccgtaatcaggattcctttaccatcgaaaatatcattcgctggttcgattactggcgtgaacgtccgggaacgggagaccgtgtaagttcgggtggcgtgaagataatcttctctgataccaatacgcactatcgcggagtagaaaattatcgtcgtagcggagtaactgacgccatgcgtattcctaaagatcctttctttgcacatcaggtgatgtgggacggctgggtagatacggaatgtcctcgcatctatatcgtcggtcattggaattataatgatacggtactgaaaccggtatatgtcgtatcgagtgccgataaagtagaattatttctgaatggtaagtctttgggcaatggtgaacgggattatcattttctgtataccttcaaagatatcgctttcgtaccgggcagactggaggccgtaggatacgacgaaaaaggaaaagaatgttgccgtactcagttgcagactgccggcaagccggaacagattcaattgagcttcatccagagtcccgaaggatggaaagcggatggtgcggatatggtactgcttcaggtagaagtcatggataaagacggcaaccgttgcccgctggcaaatgacttgatacactttgaagtagaaggacctgccgaatggcgtggcggcatcgcacaaggagaaaataattatatcctttcaaaagacttgccggtagaatgtggtatcaatcgtgctttgatccgttcgctcactactgccggaaacgtccgtatcacagcgaaggccgacggattgaagccggcagaaatcagccttacttcctcacctgtcgaagtgaaaaacggtttgagcaactatatccccggtgatgaactggaaggcaggctgactcgtggcgagactccgcagactccttcatacaaggtctcaaaagtggatgtcggtatcgtttccgccattgccggagccaataatgagagtacagtcaacagtttcgatgataatgaactgagcgaatggcggaatgacgggaaagcagctaccgcatggattacctataagttggaacgtgccgcacgggtggatgaagtctgcatgaaactgaccggatggcgtatgcgcagttatccgctggagatatatgcaggcaaagaactgatatggagcggagatacggataagagtctgggatacgtccacttggatgtaaaaccggcactgaccaatgaaattaccatccggctgaaaggtacaagcaaagaaggagatgcctttggacaaatagtggaagttgccgcccccgttgccaatgaactggatttgtttaaagcgaaggatggggacaagaccggccatgaattgcgtattgtagaaatagagttcaaggagaacttgttgaaatagttttttagggtttgtatgattggttttccaaggaccgtccatcgtactgtcagtatagtgacatcatctgtcttttttgatcggaatggagtctcctttactggcagactgaaggacgttgttctttgatctcatagagtgaatttagcaataagttggaacgttattaaaagattttctctttctttgcaataacgaaaaaacattgagccttatggattacccattgaataaccaaccggctactgatcgctacgatcgcatgcaatataaatactgtggcaagagtggcttgcaactgcctctcatctctttaggattgtggcataacttcggtagtgtagataactttagtgtagcgaccgacatgattaaatatgccttcgaccatggcatcacccatttcgatcttgctaataactatggccctgtgccgggaagtgccgaaactaatttcggacggattctcaaagaaaacttccagggataccgggatgagatgataatctcctccaaagccggacatgatatgtgggcaggaccttatggcggtaacagttcccgcaaaaacctgatggcaagcatcgatcagagtctgcgccggacagggctggagtattttgatatcttctatagtcatcgctatgacggagtcactccggtagaagaaaccattcaaacgttgattgatattgtaaagcaaggaaaagctctgtatatcggaatctcaaaatatcctcctctgcaagcgcggattgcttatgaaatgatggcaaaagcaggcgttccttgtcttatcagccagtatcgttatagtatgttcgaccgtgcggttgaggctgaaagccttcctttggctgccgaatacggttccggctttatcgccttttctcctttggcgcaaggattactgacggataaatatctgaatggcatccccgaaggctcacgcgcggcacgtccttccacttttctgcaacgttcgcaagtgacgcctgaaaaggtagaggctgcccgacaattgaatgaaatcgcccgtcaccgtggacagacgctggcagaaatggctttggcatgggtgctgagagacgaacggatgacatcggttatagtaggagcgagctcagtgaatcagctggcagacaatttgcaggctttaaaccagttggaatttactgctgaagaattaaacgggatagaacgaattttgtgtaaagtctgatggctctattgggataattggactgtcatttgctgagagtgattaaaagattattaatcataattggcgcaccaaacttatttttttatacatttgcaacggactcttccgcagaaagcctccgggtggtgggggagccgtgtatatagagaagacgtttacaagcgtttgtctttcgtgtttcagaacttcgcaaactttgaccaccggaatgacgaatagcaactaagacgtcctcctgatgtgtatttatatacatccgtgcctctttttgagaaaacaaagggaggttacgggtgttgtacatatcggcgtgggctttctgcgttgttcgttctcggtggtgggcattgcgaaggccttgaacatggaacggacgaaggtaagattcccacgcttttttatatattcctttcatcttacatttatccgtttacccggtgggagtcagggggacactcataggaagattgggcatgattcatgcgggacagcttatcgaacgtacgcttcacgaacagggacgcacagttacctggttcgccggacagttatgctgtacacgtcccaatatatacaagatattcaagaaggaaaatatcgacatccatcttctttggcgcatttcgtgcatactcgatcatgatttcttccgcgatttatccgataacatccgtatcggtacttcttcatgtgtatccaaataagatacatttctgtatcctatccggaactatgatttctcctgctggtatactcctttcgcatacctttgcggcatattaacataaaatcacaaaagaatatgaaaaagctgattctaattatgatgctggttttcggttgtgtcattgggacgtatgcgcaaaagactgtctttaagtttcgtgatgcgcaggcacgtgccggagatgcagtaaccgaagtttgtgtaaagcctacagttgtagaggtgaaaattcttgaagagaaaggacgaataaaggatgtatggacactgagcagagaagaggtggaagttgccatgaagggtgagcttgataacatccgtgcatggggaacttatttgtccactatcaagaacgattgtgatgtaatcatgggagccacttttaagatagaggatgatgaaaagtcgggaggatatacggttacggtcgtaggttatccgggcgtgttcaccaactggcatactgccacgacagaagattacgaatggatacgtatccagaaactttcgggtgccgatgatagaaccaaaatagcacctgtcataaagaacaagaattaataaccaaaaaacatagacaataatgaaaaaagtattatcaattgttgctgcgcttttgttgtgcgtaggaacacaggcacagattgtatcatccagaagtgcaatcgtcaagactcaaaagcaagcgagtaacacacaatggttcctgcgtgcaggcctgaacatcatgaacctcaacggtgacggagttgaagcggattcaaatattggctacaatgctacattcggctatcaaaagcctatgggcggtgccggagcatattggggaatggaattcggcctcggttcccgtgggtttaaagccgatgaaatgaaatgtatcgcacacaatattcaatattcaccgttcactttcggatggaaaattggagtagcggacaatcttagcatcgatccgcatttgggtgtttttgccagttatgactataccagcaaaatgaaagaaagtggtgaaagcatcagctggggagattttgcagattatctggaagtggattacaatcatttcgatgccggtatgaatattggcgtaggactgtggtatgaccgtttcaatctggatttcacttatcagcgtggattcattgacgtattttccgatctcgatggaatcaagactagtaactttatgatccgtctgggtattgctttctaattgagacacatagtttaatcatataaatttcagcatttgcgctcttttcttttgatggaaaagacgtgaatgctgttttcttaaacatagcagcgtatgataacaagactgagactttgggtaattgtatttttattgggtggagtactgccctctttgattgcacaaacttttactgaacaaaagaatacttatccgctcagtgcggacggcagcaaatatgtagtcaacggatttattcctttcagtccgatgatcgatgaaagtatttatgctaatgctctgttgtggactattaaaaacgtttgctctgcacagcgtgacggaataacagaagtaagcattcctgccaagagttttagttgtaacctggtgcttacttcccaggcggatgccaaacaaaagaatacgtactattgtacggcccaatttcaggtaaaagatgggaagctggtctattatctttccaatattcagatagaatcatcggtggttataatgaagaaagtcactccgatggaaaaactacaacctgagaagaagccttctcaccaggaaaccatggatgactttgtgcaaatagaatcgcagatgctgaacaaactgtttgattttgtcagcacaaaccagctttctcctatcacccattggaatgaaataaatatcggcaaaccggtaaaggggatgacagaagatgaatgcctgttggcttttggcaaaccacaaacaatctcagaatcaaatggtgaagtgcaatggatgtattccagctctttctatctttttttcaaaaacgggtgcgtggaaacgattataaaataaagaaaagaagtaatcccgaaattgcttctcgtgtcttatcatctttctattgatcggctattgtgtatgtctttggtaagaggaagtcagtgtgtgtgataaaatgatctgaaaagtagtgaagatttactagaaattctatcgcccttatgatgaacttgaacttggggagttgtgatttgttgttgatgtttattgttttagtgatagttcctgtttttaagcttaaaactttgacaataagcctattttttatttttatttgatggtgatatatctgtgattgtgtatgaatatgtatagtgtttaagcttgctattactagttgaaaggataataaaagtgttgggtatttgagacttttttcgatatcttgttattatatatttgtgcacattgactctttgtttatcttaaagcggaacttatatttgagataaacaaaggttctatttgaaatgaacagacattttgctttatgctttctccacagtaattcaacgcgacttttgctctcatgccctaacagattgtctgtatgcctttattcatcgtagtttcaggtatggcagcaagtgtggtagcagttatgagagcaagtgtttgctctcactcttccatgtatcattatctgtcatttaaagtgttccaaaacacgactttcggacatcttggcggtttaaactttgctaatttggcagcatgcggacattcatctattgtttttctacctttcttgtccatccagatagaaatcggaatagagatgagtaaaaaccatataaataccattgatggcaggaaaccggcttgggtttcgctccaactgaaataatctttcgcataggtgactgatactcctactaagtcacagaaccccataataaagaaaccaaaaagaactggtagtatcttacttttatttttcatatgtgtttatttatttaaatgcatttggatttggtcggtcacccataatgaaatgaagtgttcctccttttttgagtttactccattctatatagttattactaaggcgcttgttattgaatcttacatattgaatgtaacaattgtctttggatacattttctgcttttatgataagtttttttccagagtaataggtgttgtctaacagaatttctacccggtcaaatcgcggactccccagtaaccatacaggatctttgctgcaaccgccatccatttggaaaagtcctatgctgcttaagatgtaccaagaactcatttggccttgatcttcgtctcccggataggcgtctcggggacccattccataatatttttcttgtatagcacgtgcccatttctgggtgtgccacggctcactggtataagagaagaggtaagctgcctgcatatttgtttcattcccatgattaataggataagctcccatattatctcctaaagcattgaagcttactttttcggatgttgcaaatccggcattcagccggtcgatgaattgacgctctcctattaaattgatgaggctttttacatcatgaggaacgtaccaggtgaattgccaagcgctgccttcgcaaaatccgggagcatgatatgggttggtgttttcgatccactctccgttgggacgtcgggggcgtacatatccggttgatgggtcgaatatgtttttccagttatcagaacgtttcataaatgtattgaagtcatcttttttattaagagcgtcaaaatattgagcagcgcaatagtcttgatatgagtattccattgtattggaaacgtatgattgataatgcggagaattccaatcccatgcgtcatcgtatagaggtacataacctttggttatataatcgggataactttcgttaccgacttgtcctcctccgggatagtttatcatagtggctgtttgttggtgaattaatgcccgatacatgagttgactgtcgaagtcacgaattccatgttgatagccggagactatcaatggcaaagcaggattgcctatcatgactctgaaatatttcataccgggattaccattgggaagccagccgccacgacgatagaactgctcgtaagtgtaaatccaattggacatgtactccggatagagaagattataaaatggacctaatgtccaatgcattccccaagcagaatcacctccatatacgcttttacctggcttgtctataagagctttgttaccgttcatatctatccattccccatttacatcattccagatggtccgtggactgatagaacggtaaagattggtgtagaatttttgctttaagaggtaattgtctgttgtgatactgactctttggaaaagtgtttcccaggtatcttgttgattggtgacaactttatcaaaattccatccgaatggtctcgctatttcttcttccagatttagccgtgcgttatcaatgcttactaatgaaatacctgtccttaccataacatcatcaccagtgttaaggttaaagtcgaggaagattcctgcgtccagtttgtcttgactgttattttcgactgtaaatacctgtcgggacttcatgtttgatttatgtagctgttcaatttggctatatactttgtttcgtatccagccattcattgttttgaatggcttatcaaactgcatgacaaaatgtaatttatatctttgtactccatggtatcctgttgaccggcaatcgttcaaggtccatccctctatttctgtgtcagatactttttttacgtatacatcatctaaattccagtcgtattctgctggaaagaaaaagtcaactagtattcgtggctgctctgctttgttgaatgtgtatcgctgaagggaactgcgggtagttgctgttaattctgcttggatattataatctgtaagattaacagaataataaccgattcgggctgtttcggttttcttattaattcgggagcgatacccatagtccggctgtttttctgttccgggttgtatttttaaatctcccgtagttggcatcattaagagtcctgtcattgtccattcgtgaatgtggctgaatcccattatgttttcaacgttatattcatatcctgctttccaatgggcatcttcgttatcgggcataagttttaccattccaaatggcatccatggtccggggcctatcatccatcgtgaaccactggaaccagcaaactgatcaacataatcaattgatctgcgtagttgctggttactacggataaattcttgagttgctactgtttgtccttctgttgatattttaactttgattttagactggtctttaagttttccggttggaatttcgtagatattctctccttcttctacttgtttgaatatcttcttttggttgatttgtattttaagtgttccggattttttagttatagttttcagtagaagaggctgtgttcttgttttcccttgttctaattcataatcagccattttcattgaaataataggagtatcacctatcttattgatttgtgtctcttgaggtccgtttaggcaaatggcgtcaaaagttagggatttaccgttgaataactgcattacaatcttgttgtacccttcctttagaattccgggctgtattgaatatgttagctgtttggtgccaggctttataggagaatcgtaattctttccgttgacttccagtcttaagaacatacagtcttcgtattctacattctctataaaaatattccattgatatttctttagcggattgacatcggatagttttattaaaataggaagttgtatcctgcattgtcctgcccagtaagatgagccagcccattcagcagtaggccccggtataatgtatggaaaatcggccggtgtgtgttcgcctgcataaaaatattttttattatccccaaatccggagataataaatcgatcttttccatccggtgctaaggcaaactccttggatgaattatctgttttgccaagttgccagattgtgctgtattgtggatatacattcgcaatacaatatatgaaaaagataatttgtacaatagttcgtttcatagtagttggataagatgtttttattaagacattatttcaaagtaacttctttttttacaaaggcttttaccaacattattcttttgtcgggattttcatttatgattgtatatgatcgggcagcagcagggatgacaaaagtctctgcataattaaagcgttgtttcatgccgtcctctgtttcaatgcaaacggagtctccttctactatcatacatacatggcatgtattttctgtattcatttgaatacggtctttgaaggtgtaacgatatacatcataaaaatgctctttatgagtaggtagatgctctatagtacactcctgattttctttcatgatatatggatggcatatcaattcctggattactttttccccttttctttcaaaatatagattattcattccgtgttgaatgtttagaggtcgtggtttcccgtctaatcccatgcgtatccagtcgtacattttaaatgtgaaaatatagggtgcgctacttatttccaataccacgcaatcttttcctgaagcatgtatggtgccattgggaataagaaagaaatcgtgctttttagcttggtgtttttgaacaaacctttctatctctaccttcgttgctttttgttgacttcgttccaaggtatattggaattcctcagggacgatgttgtcttgaaagcctaaatatacacatggcgagtttttacaatccaatatgtaatatgtctcatcttgggtgaatggcatgttaaaatgctcttgtatatatcgggggcgtggatggcattggatagaaagattatctccgtcaaaggtgtctagaaagtcgaaacgtatcgggaaatcgtacttaaatgtttccgaacattctcctaatatattctgataatcactatacataagaaaatcgaaagatacttcaagccgatatccgtcactctccagcattagtccgttttcaagtaccatcagttcaaaagaccatgccagattatttacttctttatttaatccttgaatatgatttttcatccattgtcctccccaggcgccaggctcgaaccatggacgaactctgaagaaattgcggctcattttgtgcaatccttctcgtaggtcatttcctgaaatcattaatagttcatcccattctctttgtccgtcaataagtaggtcaatcagaggcaggcattgctttttgtgcttattaagaacaatccagtctacaaaatatagttgtttgtaagcctgttgattgtcttttcgataatctaatcctaaattattgatggctccggcgcgcattctaaactgaatctcatttttaggaatatcaatataaatcaggggagctttccattgagatagggctgctcctgtacctataaatatatttaaatctgcttccgggtcaggttgtatggaattaagcttattttcatcaaaccaattaaccaaatgcttatcagtaatggtgccgaataacggattatctcctccaagataaggagcaatcattttttcaatagtctgtggatctttcattgctacactggaatgaaagaatcgcacattctttcctctttttctgagttcttctcctaacttaatgattaattcatcccaaaagactccaatataaccatctatttttatttgggaatgcttttctatccagtcagctagttggtttatacctttcccaattttgccttttcccaatggaaatgccgggtatatatcatattctcctgatggggtggcagtagagttagtaggtgcaataaattgctgtgtgtgtcttttctcttttgtattttccatattttcaagtatgttgcttgtgtaaatagcagatccgattaatggcgacatatcccataatttacagatatctattttagtgattaaattgagtttctttaattgaaactgaatattatctaaaaagaagtcagaagctttcgctatatttcctcctataataagtttctccggtttaaaatttagcaggaatggggttatgaattctacgaaatttgaagcgaagttttcaaataatgactgtgcattattgtctccgttcgaagcgcgtagtgcgatttcttttacgccagttacctttttatctggaaatagcatattccatgtatttacaaaccatcttgtcgaaaaaaagtcatctgccattccgtctcggtaaggtatgttgtagagatatccatgttcaggtattccttctgtcagttcgttcaaaacagtatcattttcaagaaatgtacttccaagtccggtgccgattgtgactataatgcttctacttgtgtcttttgctgctcctgcataatactctccaagggcataagcggatgcgtcatttatgaaaacagtattcaggtcagatacttttttaatttcttctttaaggttaagaccgaaaagtgactgaaactttggcacaccataaatggcaactatacctttggcatagtcgcaaggaccgggcatggctataccgattccgcctaatttagataggggcatacaggcttgaatgtcagtaataacttttctgactttcgtaatgatgcttgatgttgaatctgtggcattcagttcttcgtgagatagtatgttttgatgaatgtcattcgttagaaggttgacgattccaccttttatatgtgtaccacctatgtctattcccaaataatacttcatagttattatgatttaattaattagtatgtctgaacatataaacatttgcaaatgtattctttttcttgaaaagaacaaaaagtattgcctgtttttatttttatttttatctttgtaaaaaagttaatcatgaagatattagttaaccataacagcgcaatccccctttatcttcagatagaagaacagttgaggactattatcaaaggggaggaatataaacaaggtaaaatgcttccaaatgaaattgatttgtctaaacaattgggcatatctcgtaataccttgagacaggcgattaataaccttgtgaacgaaggattgctgatgaggaaaaagggagtaggtacagttgttgtaaattcagctgtatgttccaaagctcagaattggatgagtttcacacaggaaatgaaaactttgggaattgtaccaatgaattatgaacttcatgttagctggacaaagcctacagatgatatagcccttttttttaatgctcctgatgtaaaaagaatactgaagttagagcgtttacgtggaaatcaagaataccctttcgtgtactttatatcctattttaatcctaaaataggtttaacaggaagtgaggatttctccagacctctttatgagatattggaaagagattatcatgctattgcaaaagtttctaaagaagatattagtgccaggctggctgacaagtacattgctggtaagcttgagataaaggtcggagatccaattttggtgcgtaaaaggtttgtttatgatcccgaagggtgtccgttggaatggaatataggatattatcgtgcggacagttttatttattcacttgagtttgagagaaatatttgatcttatactcataaaaaaagtgaagattataaggatgcccgaatcctgctcagcgactgcggtgttatccacagataagatgcaatgtactttaaaggcacatattgcaacagttccggagtctccttgataagagtcaggtaacgttccttcgctcgtggactgccggagttgatgagccagttttcttgcagaagaagctggtgatccatcagccgcagtcccagattggctagtccgatggaagaatgatataattgattcaaggttgcgcgggatatactgtaggctacactgtcgcacattgcttcaatattaatcagtgaataagcattgtctgcatatccccagacggagaaagctgcttctccgtctgaagcgaaccagatggtggcatctgctccgtctttgtggtaatatgcccgccatattcccgtttttataaaataaaggttgctgttctttgtcccttcacgtacaatgaggtctctctttttgaaatgtacttcctccatacagcctagtaaggtctgtacgtcactttccaatactttatatttgtcgcagagttttttaatgaatgcatccatgttgcaaatatactcatagtcggtggaccatgaagcgatctttgaaataaattccgataatatagagagtcgttaacaattctgccaacgaaaccgccagccatattcccggtactcctaaaacaagtggaagtacaaagaatccgatcagcatgaataccactccccgcagaagagtgatgatggtggctcgttgacctcgtctgatgctctggtaatagccgatgcctatcatattggcggcaaaaaatatgaatccaaccccaaaataaggaatgccattgaccgcaatatcaaaggccggacagcttcggtcaatgaacaacgaaacaatattctgacggcatagaaacgtgatgatgaaaaagctgattccgcaaattaaagctgtacggatggcaagatgtagggcttttcgaacccgatccggttgcccggcaccgaaattatagctgataatcggctgtgcggattgtgcgatggcattgtataccataaagatgatggggaagaagtagcaggcaatgctgaacgcagctactccgtcttctccgagatgatggataaagacataattccctaaaaacatcatacaggcgatggaagcctcactgatgaaagcggaagttcccagttttatcatatagccaccgttacggagcgttagcatcaggcttttcaaacttagcttgatgcgatgcaaatgaatgttgcgggagaaccgcgtaagatagattacagtcatcaatccacctactactgttcccaggctggtggcaaaggcagcacccatcattccccagccaaattcaaagatgaaaatatagtcgaatataatattgaatatagctgcgatggcattgcacatcatggcataattgggagatccgtccagccggatgaaaaacatgcctgtgctcaataactcatagaatacgaggaagggtagataccagatcatatattctatgacaagaggcaataatctgtctgaacttccgagtaagcatcccaatggccctacgaagcaaaaacataaagcagacatcactaatacgatgaacgtagagaatacaagagcctgagtaatgttgatatttgctgccttgcgtttaccttgagacagatagatggaagcgactactgagcctccgactccgaacattagtccgatgcctgttgcgatcataaaaagtggagctgttatattgacggcagctagggcgtcactgcctattcccttacctacgaatatgccgtctgtaataacgaatatagctgagaataccattcccagtaccgtaggaactaataacttacgaaacaatgtggagatgtccatactaccgaaatcaatactatctttcataacttcttatttttagtttgttgaaaacatctgcaaaggtagatggatgtaaggagattaaaattatcatttgataatttccgcctgtcatgcttgtttttgttaaatcaggatatgggatatttatctgattcttattttcatggcttgtgcgtcaaatgtgattgactcgttatggaacagtctttctatatgtccgctcgttatcatctcattggtaggcaggctgtagagttgaggattatcaatcagcatgattgtgtcgcaaagtgagagagcgatgtccaggtcgtgtgtggaaaacaggatacactttccttccttttgcgtcagcttccggagaagcagacagagttcgtagcggttgggcaagtcaaggaaggcggtaggttcgtcgagcaggatgacaggagtgtcctgtgcaagggcacgggctatcatgatgcgttggcattctccgtcggacattttgtccatcgtcttttccgcataactgtccatgcctaccaggtgcatggcgttgtccaccttctccttgtcttctccttgcagctgaccgagccagttggtatagggagcacgtcccagtgcgacgacgtctctgcatcgcaggttggcaatgcgcactttgtcggtggtgacgaagctgatgttccgtgccagttcttccggtttcagtgaagcgatgttattcccgtgcaggataatctctccgttttggggcttttccagtcccatgacggcacgcagcagtgtactttttcctgtgccgtttctgccgagcagtgcgacgagttgtcctcccgtgatgtgggcggagactttttccagcagcgtacgctgttcgtatcccagtgtcaggtctttgagttgaatcatttgaatatacgcaagtttttacctattacccataaaataaccggaactcccagcagtgcggtgatacaattcaccggcagcaggaatttcttggcgatgatgtcgcatatcagcatggcgataagtcctgtcagcatggtgcccggcatcagtatccggtggtcggcgttatcaaacagcagccgggtgatgtgcggcactgccagtccgatgaatcctacggggccgcaaaaggcggtgactgttcctgtcagcagtgctgtagagatgaagacaagcgtccgcgagcgtttgatgctcatgcccatcgtgcgtgcgtagttttcgccaagcaagagcaggttcagtgacttgatgcaggctacggagagcagcagacctatgcacacaaccggtatcatgatagacagctgtccggctgtgatgtggctgagcgatcccattgaccacagggtgaacattttcagttgttccgccgaacttagatactgcaatatctggatgatggctcccgctacgtagcctatcatgactcccatgatcagtacgcccagtatattctttactttccggctgatgatggctacgcccagcaagatgacggcggtccctatccagcccgaacctacgatgccggcggattgcaaaagtgggaaatctgcccagcctagcaacggggcacctaatataaacaacgccactccgagtcccgcaccggaactgactcccagcagataagggtctgccagcgggttctggaaaacggtctgcatttgcaggccgctgaccgacaaggcgatacctatcaaccctgctactactacccggataaagcggatggagagaaggatgttgcgtgtcatctcgtcgcattcgcctcccgtcagtacggcccatactttggggatggggatataagtgtcccctgtcgccatatctattaataataagactacggcgattattcccaaagtgatgaataaaagagtggtgtgtctacgaggttgcttcattctagatgtctgtaatagtaggttgagtcggatacaagttcgggatgaaagatatgaatcagatcacgcaatacgacgtccggacgtacgactgccgattcccagtagtcattgcctcctgtggcggttatccgcaggttgttgttataaactgttttatcacggacagatttggcatcggcaaacttgggattcatgtttttcagttcgtccagtgtggatgccgtgcctacattgatccaatagtctgctttttgtatcagtccgtaggcagtttccaggccgatgggggcggagctgttggaggtgttctccttatatatatagtcggctcctgcgtcagtgaccagttgtgccatatagctctgggtggaaggcatcacccagctgtcgttccacggggtgttgaacatcacggtagggtgatgctctacggatgcggtaaggtctttcagtgcctgatagcgtttggggatttcactgaatacttcgatgcctttgtcacggctgtctgtcagttcggagagggcaaccagccattcggctttgccaagcggtgactcttccagatattctcctacatacatataagggatagcgagttctttcagcttgtctgtcacggctgtctgggcatcaccgatgccatatagcagtacgacgtccggctttaatcccagtaacagctcgtagtttatttcaggacccatgtccttgatagaatctttgtgagcgaggatgtagggattggctatgtaattgatgccggatacggcgacgatgcggttcatctgtcccagtgcgtcgagcatggcgatgtaggaagaagacatacatacgatgcgttgggctccggcagggatggtcggtccggtgaatcctgcgggggggagctcaccattgcgggagatgaagtaggacattgttacatctttggctccctgccacgggttggatacttgtatcaaggtgctttgggcattctttgcgcccagtatcttgaatccggtagcatattcgggcatgtatacgtcttgcttgaatgcttccaaagaagtttttttattgtatacgcagcttgccaaagaaaggaggcataatagcgtgatagttgaaataatggatttaaatttcatacggatgtttttatctgaggacaaaagtagtaaaaaagaagaaaattcacctcccttacgagaaagtttcgctgggaggtgaatgtattgaatctaacttttcagtattgatgcggaaagttatttgacgaatactacggcgttcacgttggctgtgccggtattgtttgctttacaacttcacaacttaatttagagtttaggtacccatactttatgactgctatctcttttacgattagttatcgagtagtaaggaatagcaatagcagtcgtttttccgttacttttgattatattcactccattcagtaagtccttttgataaatgatttccaatggagcatttgtgtctaatcggaaatctttgaaatccggattatctacgtcttcaaaacagtagatgataggaccggaagctatacaaactgtgttgctcaaatcttttgtgttagtatgtgcggtgatgatgcggggttgtataggtagttcaagctcgattaggtctcctttctgccactttctattgatttcggcataaccgtcaacgattttaattggaacagatttcccattgacgaacagttggggcgctccttttaagtttgattgataaagctcgtatggattctcaatgccttgtgcccatcccgggatacgtactttaatcggaaatttgtctgttttctgtggatttacggaaatattgactttgcctttccaagggtaggatgtttcttgttttaattgtacgctgtttttggaagaaagcttgatttctgtttcactgcctatgaacaggttaatataaactccttttttgtctgatgcatagatgaatcccggaagagcagatgtgattttcaagaacattggaggacagcaagggcaaccatgccattcccaacgattatgtttctctgcgtttaagggattctgataggtataattgtctcctttgagtgaaactgcggtaagcaaactgttgtatagaacgcgttccagttcgtccatatacattcctttaccggttagctcgttcattctttggctaaagaatccggcgccaatggcagcacaagtttccagataggcacccggaggaaggaaaaagtctggaccgaatttttcgtcttcgtggatagcgccgactcctcctgtgatgaacatacgtctaccggtcatattgtcccaaaggcgcttggctgtttctatatatttaggtgaatgattttccaaagcggcagtagtgataccagttgctaatagtgtggcgcgtacggcatgtccttcaatggtttgttgctcaaataccggaattgagtcttgagcataatctccccatgtcggacgactatgctcgccatgctcaggagcattatattgggcatctctgatccatttttcggatttgccattgccccaagtcaaccataaaggatagccacaatgatgccctctgttttcaatccagaaagtagctagcttccagtaagcgtcttcatttacggacactgataattgttttttaagttccggttgttctttgaatagccagtatagtttgataatggcttcttccgggccggagtgagagggaacaatatttttcttgggtgctggtcccatatagtctgccatgtaatttgtatagcgggtggcgacttccaacagtttggtttttccggttgctttgtagtaatgcacagcggcttcaatcatcatgccggcattatacacatcgtgttgccaccggaggaaaccaccattgtctccccaacggtgttccggttctttcagaagtgtataagtctctaagtatccggttggttctgtcatttgtgctgcttcgatacggtcgatatatctgtcaatacgtgtttccagttctttatccggatacatgaccagataatctgcaataccccgaatcgattcatagataagtccgtcgaaccacggctctccgaagtgtccctgtgtgccacgttcacctttggccactttatcaaaattacagaaagcattgtgctgttccggggcgttggtgtgtttaccctcgaatttgtttagtacatcattgatggttacttcattccatgttttaaatttggggctccagaatgcgtcgttcacttttacgttttcaatgttcgcaaattgtactttcccagtctgtccttgtaccgcgctatgtggagttccggatagtgttgctataactgccaaggatttaagtagatttgtacttttcatgtttctaactttatgtttaactttctaatttatatgaagatgaatctgccgcaaagatagaatattctttttgactagtacgaactggtctgtatgttgtaaaacacataccactccgtaccagtatggctgtgatatttgtatctttgcgcaaaaataacgaacgatgaaaagcaataaatcaaaatataagttggtagttgattatgtgatcgacgggattaatgaaggacgattaaagaaaggtgcctggataccttctcttaatgaatttagagaaatgtacggcttgtctcgtgatactgttttttccggaatacgagaattgaaatcgagaggtatcattaaatcgaatcctggagtcgggtattatatcgtaagtacgcgtgttccgttcaaacacaatatatttctgcttttcaatgagttcaatgaatttaaagaagatatttataattcttttatggagacagtaggcaattcagctactgttgatctttattttcataactataatcggaaggtgtttgagactttggtgaataatgcaaaccataaatatactacctatattataatgtccggcaaatttgccgatattggtcctttactggagagtttatccggaaacgtatttctactcgatcattatcactcggaattgaaagggaaatattcgtctgtattccagaactttgaaaaagatacttatgaagcattagtgtatggtctgtccaacttgcgaaagtacaagcatattgtaatggttcagaaagattcgaaagaaccttttgaacgttatgacggattacgggctttttgtaaagagcatggctttacgcatgagtgcattggcgaaattcagggaagggagattgtaaagcaggaggtgtttatggttgttaatgatagagacttggtcaatttgttgaagcaggctgaccgtcagcagttagttccgggaaaagatttcggtattatatcttataatgatacccctttgaaagaagtgctggcaggagggattactactctttctactgatttcaaattgatgggacgcacgatggcttctcttattaataaaaaaacgattgagacaattgagaatccttggaatttaaatattcgtaattcactataaagactatctatcctatatttatcatatatacatgttcatagtgacgtcattttaaaagattctgttcatcagatttgttcctgttaaaaaaaagacaggggagaagtgaggcgtgaagtataattatagtatctttgcacctgcaaggttcgtatttggagttgtctaaccttccaaaacgatgaaaagggaatccggtgtaaatccgggacagtacctgctgctgtaagtcctctctttcgggagatgagtttatcacattctttgccactggtgacatcactgggaaggcgtgataaatggggacgagtcagaagacctgccttgacgctgcagatttatacccgcgggttttcgggtagaaatcaactggtatagttcattcctatattcaattgattcctcattcaaccggtcggtacaaatgctatgtttgatatttgtcgcaaatcctgatttgccggcagatgtctgaagagtgatgcgacaagttagttaataaccttttctcgcttttaattatgaaacgaattttactttctgttttatttattgtcttctgtctgacggcttttgtcggttgtatgaaatgggattatggcaagatggagcctttcagggctacaggagatggacttttcattatgaatgaggggaattttcaatacggtaatgctaccttatcttattatgatccggaaacgaaaaaggtggagaatgagatcttttaccgggctaatgcgatgaagttgggtgatgtagcgcaatcaatgattgtccgggatactattggatgggtggtagtgaataattctcatgtaatcttcgctattagcaccaatacattcaaagaggtgggacgcattacgggacttacttctccacgctatattcattttatttcggatgagaaagcttatattacacaaatatgggattatcgtatttttattgtcaatcccaaaacttatcagataaccggatatatcgaatgtccggatatgacgatggaaacaggctcgacagagcaaatggtgcagtatggcaagtatgtgtatgtgaattgctggtcttatcagaatcgtatattaaagatagatactacaacggacaaggtggtagatcagcttactgtaggtatacaacctacttctctagtgatggataagaacttcaagatgtggacgattactgatggagggtataaaggaagtccatacggatatgaggagccgtcgctttatcgcattgatgccgagacatttaaaatagagaaacaatttaagtttcagttgggagatgctccttcggaagtacagcttaatggtgcgggtgatgagctttactggattaacaaagatatctggcgtatgtctgtcgatgaagaacgtgttcccgtacgtcctttcctcaagtatcgtgatacgaagtattatgggttgacagttagtccgaaaaacggagatgtctatgtggctgacgccattgactatcagcaacaggggatgatttatcgctatacggaggatggggaacttgtggatgagttttatgttggaattattcccggagcattttgttggaagtaatcggtagagaagaatatgaggagaaatatattattagtgcagtttgtaggagttcttttattacttccatctataatgagtggacaacaacacagcagcgacaataagaattgggcggaaaagggaattgtcattcgtgaagtggaaattttaggaaagcgcccgatgaaagatataggcgtacagcagaccagatttgattcacttgtgcttaaggagaatatagccttgtcaatggcggatatactcactttcaattcttctatttttgtaaaaagctacggacgtgccacgctttctactgtatcatttcggggaacgtctgcttcgcatacacaggtaacatggaacggtatgcgtatcaacaatccaatgttggggatgactgacttttcgatgattccatcttattttatagatgacgcttctttgctgcatggcacttcatcggtgaatatggctggtggtggtttgggaggattggtgaaattatctacagtgcctgctcatcaagaaggcttcggaatgcaatatgttcaaggtatcggttcatttagtaccttcgatgagtttctgcaattgaagtatggagataaacattggcagatctcgacgcgggcggtctatcagtcgtcgcccaatgattataaatatcgtaatcatgataagaaagagaatatttatgatgataaatataatataatcgaacagtattatcccatagaacgtaatcgtagtggtgcatacaaagatctgcacattttacaggaggtatattacaatacgggtaaaggtgatcgcttcggactgaatgcgtggtatactgattctaaccgtgaactggcattactgacgaccgatcagggtgatcttatggatttcgagaaccgacaacgggaacatacactgcgaagtgttttatcatgggatcatacgcgtgaaaactggaaagtatcggcaaggggaggttatgtgcatacatggttggcgtacgactataagcgggatttgggaaatggtataatggctacaatgacccgttcacgtagtaaagtcaatactttctacgggcagttggatggagagtattttttctcagataaactccttttgacggcgggtgtgtcggctcatcagcatttggtgaatagtttggataaagatctgaataaagatgataataagaacgataagtatggtcagggaaggaagaatgattctattgtttattttgataaaggacgtattgagttgtcgggtaatgtctcattgaaatggcagccggtcaatcggttgggtatgtcattggtcctgcggggagagatgttcgggactaaatgggcaccggttattcctgccttttttgtagattatgttctttctaaaagaggcaatataatggcaaaggcttctattacccgtaattatcgttttccgacattgaatgacctttattttttgccgggtggcaatccggcattgaataatgaaagtggatttacttacgaaacggggctgtccttttctgtggataaggataatgtttatacattatccggttcggcttcctggttcgatcaacatataaacgactggattatttggctacctacgtcgaagggattttattcccccgttaatcttaaaaaagtacacgcctatggcgtggaagtacaggctgattatgcagttgcaattgataaagcatggaagcttggattaaatggaacatttgcgtggactccttctattaatgaaggtgaacctacgagcaaggctgaccagtcagtagggaagcagttaccatacatacccgaatattcagctacgttatcaggcaggctgacatatcgcagttgggggcttctttataaatggtgttactatagcgaacgttatacaatgacgagtaatgctgtatcctatacgggacatcttccaccctatctcatgagcaacgtgacccttgaaaaaggattctcactccgttgggcagatttatccttaaaagggacagtcaataatctctttgacgaagagtatctttcggtattatcccgtccgatgccgggaattaacttcgagttctttatcggtataactcccaagtggggcaagaagaaaaaataggtgggtgatagccggactcctgtgccatgtagatgtattattggcagagtatatatgaaaaaaggatgctttccgattgtttcttttaaatataacttttgtataatggtgcatcttttagaaaaaagtcgtatgtttgctatcaaaccataaaacaaaatgtactatgagcggtaattatgttatcaatatcggtcgccagttaggtagcggcggaaaagaaataggagagaagttggctgcccgtttgggaatcgacttttatgataaggaactgatcaatctggcttccgaagagagcggcttatgtaaggagttcttcgaaaaagctgatgaaaaagcctcgcaaggcattatcggcggactgttcggtatgcgttttcctttcatcagtgaaggggcaatgccatgtaccaactgtctgagcaatgatgctttatttaaggtgcagagtgatgttatccgtcgtctggcggcagagaaatcctgtgtgttcgtcggacgttgtgccgactatattttacgggaacatccccgttgtgcaaatgtctttatctcggctactaaagaagatcgtatcgcacggttgtgtcagatgcatcgtattgatgaggaggcggcggaagagatgatagaaaaagcggataagagacgttcggagtattataattactacagttataaaacatggggagcagcggctacttatcatttgtgtgttgattcctcttctttggggattgaggagacggtgcggtttgtggaagagtttgtggctaaaaaactacagattggaatgtaattgaaaaagaaaacaaaatcccgataataataaagccggctaaattctttctgaatttggtcggctttatttattaattaaattagttcgctttacatcatcgccagtaatatcatctgtcccgtcaggatacgaaggaacatagataatggataaacagtagaatatcctactgccggtgcatcactggatgtcacctgattggcataagccaatgcgggagggtccgtattactaccggctatcaatcccatcagagtgaagtagtttaccttataatatagtcttgcaattgcaccgatgataagcaacgggatgacagtgatcaggaaaccacagcctacatacagtaagccgtcgccttctacaactgtttgcacaaagttggcacccgcatctatacctacactggcaaggaatagcacaataccgatttcgcgcagcatcaggttggcactcattgtggtgtaagtcaccaaatgaagtttgtgtccgaaacgtccgatcaggatagctaccaccaacggaccaccggccaaacctaatttcaaaggagtcggcataccggggaatgcaatcggaagacttcctaaaagaatacctaagaagatacctacgaagatagtaacgatattcggtgtgtccagacgtttcagttggttacccaaaacaccagctacacgctctaccgcatcttgctgacctactaccattacgcggtcacctacctgcaatatcaggttcggatcagcgaacaggtccataccggaacggttgacacgggtcacgttgacaccatacatactacggaagtgcatggaaccgagcgtttttccgttaatttccggtttagtaaccagaatacggcgggaaaccatcggaagatcctgcttctcccagtccagttcgacttcttttccgataaatacggtgatggcgggagcatcttcttccgaacagacaataaacaactggtcgcccatattgaatatcgtttcgtggttcggaatacttacgtgtccttcgtgacggatacgggagcaaacaaagttgcgtcccagaaattctttgatttcaatcagtgtttttccgctgatagactcattgcgtacctcaaggctcatcatgtgcggcttgtggtgcgcgtctccgctctgagttttcaggctctcttcctctttggtcatattgacgcggaagatgtaacggatagctatgatagaaccgatgatacctaccacacccagcggatacgcacaggcataacccagtgcaatctgcggtccgttgtagctcaactggttcagggcctcattggcggcaccaagtcccggagtgttcgtcacagctccgtagaggatacctaccatcatcggcagttccacacgaccgttccagaggtaataaagccccaatgcaacagcaatatttaacactacgatgcctacagccaacaggttcaatgtcattcccccctttttgaaagaagagaagaatgatggccccacctgaagaccgatacagaatacgaacaagatcaatccgaattctcggatgaaatgtaggatgtgtgtatcggctgtgaagccgaaatgtcccattaggatgccggcaaacaaaacaaaagtgactcccaaagatactccgaatatctttattttaccgagatacacaccggctgccactacaaaagcgtagaggaatacaatgtgcgctacggagctagggtcccacaataaactttgtaaccaatccataaatattagtagtttttataatgttcttttaaaaacgggtgcaaaattactcattacatcggagctaatcaaataaaaggagaactaaaaatgaagaatgaggaatttgcttcgtttagctttaagttgcatggagattcttcattctatagtttatcattcttcattttctctctgtaacctgtagtgcgaattttttctaaaaagaggaatcgttcgaacttattaattatatttgcaagtcgaacgactgacatttagaaagagacaaataaaaataaagacaatattaattcttgttttaattttaaataaactatggcagacaaaaaagaaaaactcttctcagacttttctcctgtctccaccgaacaatggatggagaaggttacagccgacttgaaaggtgctgattttgagaagaagctcgtttggaagacaaacgaagggttcaaagtgaaacctttctaccggatggaagatctggagggtttgaaaacaacagatgcacttcccggagaatttccctatctgagaggcaccaagaagagcaataatgagtggctggttcgccaggaaatcaaagttgaatgtccgaaggaagccaatgccaaagcactggatattctgaacaaaggtgtggattcactttctttccacgtaaaagcgaaagaactcaatgcggaatacattgaaacactgttgaatggtattcaggctgagtgtgtagaactgaacttctctacttgtcagggacatgtggttgaattggctggtctgctggtggcttatttccagaagaaggattatgacgtgaagaaactgagaggttctgtcaattatgacttctttaacaagatgctgactcgcggtaaagaaaaaggcgatatggttcaaactgccaaagccctgatcgaagctatccaaccgcttcctttctatcgtgtactgaatgtaaatgcaatctcgctgaacaatgccggagcttacatttctcaggaattgggctatgcattggcatggggtaatgaatacatgaaccagctgacagacgcaggtatccctgctgctacagttgccaagaaaattaagttcaacttcggtatcagttccaactacttccttgaaatcgctaaattccgtgcagcacgtatgctgtgggcaaacatcgtagcttcctaccatcctgaatgcctgcgtgattgcgacaataagggggctaatggagaatgtcgttgtgctgcgaagatggcggttcatgccgaaacttccactttcaatcttactttgtttgatgctcatgtgaacttgcttcgtacacagactgaagcgatgagtgctgcattggccggtgtggattcaatgacagtcgttccgttcgataagacttattcgactccggatgaattctctgaacgccttgcacgtaaccagcagttgttactgaaagaagaatctcattttgataaggtgattgacccggctgccggttcttattatatcgagaatctgacagtgtctatcgctaaacaggcgtgggaactcttccttgccgtagaagaggcaggcggtttctatgctgcattgaaagccggtacagttcaggcagcagtgaacgaaagcaacaaggcccgtcataaagcagttgctcaacgtcgtgaagtgctgctgggtaccaaccagttcccgaacttcaatgaaaaagcaggtgagaaacagccgatagaagcaaaatgctgctgcggaggtgatgctcatacttgcgagaaagatgtggatactttggtattcgaccgtgcagccagcgaatttgaggcattacgccttgaaacggaggcttccggcaaacgtccgaaagcgttcatgctgactatcggtaatctggctatgcgtcaggcacgtgcgcaatactcttgcaacttcctcgcttgtgccggatatgaagttattgacaatctcggattcgaaacggtggaagccggagtagaagctgctatggctgctaaagctgacattgtagtcctctgttcaagcgatgacgaatatgcggaatatgcggttccggcataccatgcattgaacggccgtgctatgtttatcgtagcaggtgctcccgcttgtatggatgaactgaaggcagcaggtatcgagaacttcatccacgtgcgtgtcaacgtattggataccttgaaagagtttaacgccaaactattgaagtaagatgagaaaagattttaaaaacttagatatatatgctgcatttcagcccgctaacggtgctgaatggcaaaaggctaacggtatttccgctgactggaatacaccggaacacattgatgtgaagcctgtttatacaaaagaggacctcgaaggaatggaacacctcggctatgctgccggacttcctccttatctgcgtggtccgtattcagtgatgtacactcttcgcccctggaccatccgtcagtacgccggattctctactgccgaagaatcaaatgctttctatcgccgtaacctggcttccggtcagaaaggtttgtccgtagcatttgacttggctactcaccgtggttatgaccccgatcacgaacgtgtggtaggtgacgtaggtaaggcaggtgtatctatctgctcactcgaaaacatgaaagttttgttcgacggtattcctttgagcaagatgtccgtgtctatgacgatgaacggtgcagtacttccgattatggcattctatatcaatgcaggtctggaacagggtgctaaactcgaagaaatggccggtactatccagaatgatattctgaaagagttcatggtgcgtaatacttatatctatccgcctgcattctctatgaagattatttccgatatcttcgaatatacttcgcagaagatgccaaagttcaattctatctctatctccggttaccacatgcaggaagcaggtgcgacggcagatatcgagctggcttatacattggccgacggtctggaatatctgcgtgccggaacagcggcaggtatcgatatcgatgcgttcgctccccgtttgtctttcttctgggcgattggtaccaatcacttcatggaaatcgcgaagatgcgtgctgcccgtatgttgtgggctaagattgtaaaacaattcaatccgaagaatccgaaatcactggcattgcgtacacactctcagacttccggctggtcgctgacagaacaagatccgttcaataacgtaggacgtacttgtatcgaagctatggctgccgctttgggacatacacagtctttgcataccaatgcgctggatgaggctattgcccttccgacagacttctccgcacgtattgcccgtaatactcagatttatattcaggaagaaacctatatctgtaagaacgttgacccatggggcggttcttattacgtagaagctctgaccaacgaactggctcacaaggcttgggaacgtatcgaggaagtagaaaaactgggtggtatggcgaaagctatcgagacaggtattcctaagatgcgtatcgaagaagctgctgcacgtacgcaggcccgtatcgacagcggttctcagactattgtcggtgtgaacaaatatcgtctggaaaaagaagctccgattgatatccttgagattgataacacggcagttcgtcttgaacagatcgagaacctgaaacgtttgaaagaaggacgtaaccaggcagaagtggacaaagcactggcagccatcaccgaatgcgtagagaccggtaagggcaacttgctggaactggctgtagaagctgctcgtgttcgtgcaacgctgggtgaaatctcctatgcttgcgaaaagattgtaggacgttataaagcaataattagaacaatatcaggcgtgtattcatcagaaagtaaaaacgatggcgacttcaagcgtgcatgtgaactggctgagaagtttgctaagaaagagggacgtcaacctcgtattatggttgcgaagatgggacaggacggtcacgaccgtggtgccaaagtggtagcaaccggttatgcagactgtggcttcgatgtagacatgggaccattgttccagactccggcggaagctgcccgcgaagctgtagaaaacgacgttcacgtagtaggtgtttcttcattggctgccggacacaagacattgattccgcagattatggaagaactgaaaaagctgggtcgtgaagatatcgtggtaattgccggcggtgttatccctgcacaggattatgacttcctgtataaggcaggtgtagctgctattttcggtcccggtactccggtagcgaaggctgcttgccagattctggaaatcctgatggatgaagaataaacacggaatttaatcattttttctattttttttatcccgccttatagctccattcgggctgaaggcgggatgtttttttcatctttatgcggtcagtgagaaataatcatgtaactttgtagactgttagtataaaaacaagaagagaaaaaatgatagtttgcatagccgaaaagccgtctgtagcacgtgatatagccgaagtactcggcgctcatacaagaaaagaagggtatatagaaggaaacggataccaggtaacctggacattcggtcatctttgtaccttgaaagagccgcatgaatacactcctaactggaaatcatggaacttgggtagtttaccgatgattccgccacgtttcggcatcaagctgatagagaaccctacttacgaaaaacagtttcacatcattgagggattgatgcagaacgcggatgaaatcatcaactgcggtgatgccggccaggaaggagaattgatccagcgttgggtgatgcagaaggcaggtgcccgctgtccggtgaaacgtctttggatttcttcgctgacagaagaagcgatccgcgaaggatttgcgaagttgaaagaccagtcggattttcaatcactgtatgaagcgggactttcccgtgcaatgggggactggctgctggggatgaatgccacccgtctttataccatcaaatacggtcagaacaaacaagtgctttccatcggtcgtgtgcagactcctacgctggcattgattgtcaaccgccaattggagatcgccaacttccagccgaaacaatactgggaactgaaaacgaattatcgtgatactaccttttctgctctgatccgtaaaagcgatgaagaaattgctgcggaagaagaaaagagtggcggaaagaagaagatagacaatcccggcatcgaccctatcgccaaccgggaggagggagaagcgctggtggaacgcataaaggaccttccgttcattgtcaccaatgtcggcaagaaggatggaaaggaatatgctccgcgtctgttcgacctgacttctcttcaggtagagtgtaataagaagtttgcctattctgccgatgaaacgctgaagctgattcagtcgctttatgaaaagaaagtggctacttatccgcgtgtcgatactactttcctgagtgacgatatttatccgaagtgtcccggaatattgaaaggtcttcgggactacgaggtgctgactgctcctttggcgggtgcttcattgcctaaatcgaaaaaggtatttgataattcgaaggtaacagatcaccatgccattatccctacaggcgtttatgcgcagaatctgacggatatggaacgtcgtgtctatgacctgatagcccgtcgttttatagcggtgttctatcccgattgtaagatttctaccactaccgtgatgggcgaagtggacaagatagaatttaaagtaaccggcaaacagattctggagccgggatggcgcgtcgtttttgccaaagatgtgaaagatacttccgaagaaaaagaggaagaggatgaaaatgtacttcctgcctttgtcaagggggagagtggtcctcatgttccggacttgaatgagaagtggacgcaaccgcccagaccttatacggaagcaacattgcttcgtgcgatggaaacagccggaaagttggtggataatgacgaactccgtgatgctctgaaggagaatggtatcggtcggccgtctacccgtgccgccattatcgagacgttgttcaagcgaaactatatccgcaaggaaagaaagaacctgatagccacccctacgggagtggaactggtacagatcatccacgaagaactgctgaaatctgcggaactgaccggtatatgggaaaagaaactacgtgagattgaaaagaagacatacgatgcccgtcaattccttgaagaactgaagcaaatggtatctgaaatcgtgatgagcgtactttcagataatacgaaccgacgtatcactattcaggaggcagttgcccaaacggaagaaaaggcaaagaaagaacctaagaagcgtgagcgtaaagcaagtgctcccaaagaaaagaaggcgaaagcagaaccgaaagttcctgcatcttctccgtctcctgctctgactccttctgctcctgcctctgctccggctaccggtaatgcagatacttttgtcggacaaccgtgtccggtttgtggtaagggaaccatcattaaagggaagacagcttacggatgttcggaatggagaaatggatgtacttaccgaaagaatttcgaatagtttgtggacagtgtctcacataacagtgatttctcttttttcaaagaaaaagagtcccttcttttctgttcgcaccataaggaattagatagccgttttgctatcacgctctcactatccacttgtatccctttattcatcgatgtttcagggatggtagcaagcgtggtggcaagtatgagagcaaacggttgctctcactctgtctcgtcctgattagtatcgtttttgtaatgttatcttttgatttacaggatgttaatgtctgatgtgtcagttattaacgtttgatttctcaaccattaataactgagaaatcaggtattaaagactgagaaatcatgtattattgaccaataattgattttatgcttcctaagagaacagctcaatcggaataactgatatggttaatgtgattgaaacgtgcagtcaagtcaatcaaatcaacagtacattcagatagtttcagacgcttgaaacttttggtttcaacctttgaaaccaatggtttcaaggcatgaaactattagttccaacgcttgaaactaaaagtttcaaaggtcgaaactggtgattgatctatgtaaaccagtattatgataacgggattttaccgtataggtatatgcatccggggtggtccgattgtcgggccggatggaccacctatacctctgtttttatcaaaaacggcattgcggagaatctcatatataataccacccacatccaaacccagtgtgaacttatcgaaatggtagtaaggaatcataacgggaaccgtttcccaacgtccgctcatcgcgtcatagtatcgctgtactcccatttccatcccgaagcggtcggacatatcgacggacatcgtagctccgtagctatgggtactcattccgtaagaatttccgatgtcgtatgacccgaagaccttgaaggtgacatggtcggaaggatgataaaggaaggcgcccgaagtgctgaaagcctgtccggtgatatgggacatgttgaccttcagcgcattggcacggacttgtaactcgaattgctcattgaaaatatgctgataacctagtgaagcactgttgaaacgcccgatgcctgccatacttgtctggcttccggaaccgaacagtgctccatgatcgaattgatgcaataccccgcccgtgctgtaatcacctcggaagagtagggaaggattggtctgataaggtagggaaatatcccttttgagtgaaaagcggggtatatgctccaactgtccgggtgaatataaagaatatgtagtgctcttttctggaaacaagttaatgttggcctgtttaagtacgtcgtccggcgttatggatgcaccgttacgaagtatgtgcgtgctgtcgttgttttcttgcgcggagagtaactgcggaacaaaatacagcaaaagaaagattcccaaacgaattggaagccgtgatatgctaactttttgtctcatacgcatttgccctccttagtttttatgataggttatgtacaaaaataatgaaatcccatttgaaaagcaaataatgtgtaatgtttccttccatccgcaggcttttttaactcaaataagagcagataagattttttctgaataaattcccttttttcccttaaattcttctctctctcaggcaatattcgttgtatatttgttattatagatataagagtatcaactatttaatttggaaggaatatgaagaaaaaacttacgggtgttgcattggtgttagctgccgtctctttgatgggcatacagccggcggaagcatgtacgcgtgccgtatatctgggaccggacggaatggtggtcactggtcgcacgatggactggaaagaagacatcatgtcgaatatctatgtgtttccacgtggaatgcagcgtgcgggacacaataaagaaaaaacagtaaactggacttccaaatatggaagcgtaatcgcaacaggctatgatataggtacttgtgacggaatgaatgaaaaagggctggtggcaagcctgcttttcctgccggaatctgtttattcacttcccggagatacccgtccggcaatgggaatcagtatctggactcaatatgtacttgacaattttgcaacggtgcgtgaagcggtagatgaaatgaaaaaagagactttccgcattgacgctccccgtatgccgaacgggggaccggaatctactttgcacatggctattaccgatgaaacgggtaacacggcagtgatcgaatatctggatggcaaactgagtatccatgaggggaaggaatatcaggtgatgaccaattctccgcgttatgaattgcagttggctgtcaatgattactggaaagaagtgggcggattacagatgttgccgggaacgaaccgttcgagcgaccgttttgtgcgtgcctctttctacattcacgccattccgcagactgccgatgcaaagatagccgtccccagtgtgctgagtgtgatgcgcaatgtctccgttccgtttggtatcaatacaccggagaagcctcatatttcttctactcgctggcgttccgtttccgatcagaagaataaagtgtattactttgaatctactttaactccgaacctgttttggctggatttgaagaagattgattttagtccgaaggctggggtgaagaagttgtccctgaccaaaggagaaatttacgcaggagatgccgtgaaggatttgaaggatagtcaatcatttaccttccttttcgaaactccggtgatgtaattgttagttatgtggtaagatgtctttttttgaataaaaaggaacggtaggcaaaggatttatccgcttgtctaccgttcttcttttaatttcgtgtcctgcgtgcggctataggcagcctttatcttttcgcatattcctgatggaactcaaccaccgcctctattcctttccggaaaatgtccagcgagaagttttcgttgggtgaatggattgcatccgattcgagtccgaagcccattaatacggttttggttcccaatacctgttcgaatgtcgaaatgataggaatgcttccgccgcgacgcactgccagcggttttttgccgaaagctatctcaaaacctttttccgcagcctgataggcaggaagggaaatcgggcagacatacccttgtcctccgtgcatcggagttacttttacctggacagtgtcgggggccatttgtaagatatagtcagcaaacatctgcgaaatcttgtgatgatcctgatgcgcaaccagtcggcaggaaactttcgcatacgctttcgaaggaaggactgtcttggagccttcacccgtatatcctccccaaatgccgcatacatcgaaagacgggcggcaactgttgcgttccagtgtgctgtatcccttttctccgaagagttctttcactccgatggcttctttgtatttcttctcatcaaacggaatatgggcgatcatttcccgttctgcttgtggcacttcttctacgtcatcgtagaatccggggacggtgattcttccgtctttatctgttactttgctgattatttcgcaaagtacattgatcggattagctaccgcacctccgaagtgtcccgaatgcaggtcacggttcggtccggtcacttctatttcccagtaagccagtccgcgcagaccggtggtgagggatggaagttcggcacccagcatgctggtatccgaaaccaggataacgtctgctttcaacagctctttatgctcttcgcagaaggcttccaggctgggagagccgatttcctcttctccttcgaagataaacttgacgttatttttcagcagttcgttcttgacgagatattcgaaggctttgacctggataaaggattgtcctttgtcatcatccgctccgcgtgcccagatgtatccgtcccgtacttcgggttcgaagggctggcttttccacagttccagcggttcggcaggcattacgtcgtagtgggcgtagaccaatactgttttggcattcgggtcaacgatcttttgtgcgaaaacaatcgggttacccttggaaggcatcaccaatgcttcctccactccggcttcgagcagtagttgtgcccagcgttgggcgcaagccagcatatcgtcgtgatgttccggcagggcgctgatactgggaatacggatgaggctgaacaggtcctccataatcttcggttcgttcgctgcgatatatttttgaatttcgttcataatgaatagtttactggcggttatttagcctatgtgccaatagcctgacagatttttagtgcaggtattggcacatgggtagattgacatattgatacttattaaagctgcgttgtcttatccaacagataataatcaaggatggtcatggcagccattgcttctacgataggtacggcacgtggcagtacacaggcgtcatgacgtccgcgggctttcagtgtcgtatctacgccgtcgatgttcaccgtttcctgctccatcagcagggtagcaatcggtttgaatactacacggaagtaaatatcctgtccgttactgattcctccctgaatacctccggagtggttggtatgcgtttcaatccgtccgttgttgttgaagaatacgtcgttctgctcggagcctttcatcttcagtcccttgaatccttctccatattcgaaggctttggcggcattgatactgagcatggcgttgcccaaggcggcgtgcagtttgccgaacacgggttgccccaatccgataggacatcctttgatgacacaggtcagcgtacctccgatggtatcgccttcgccttttaccttatatataaggtctgccatttccttcgccttttcagggtccggacaacgtacatcgtttgtttcgatcaggtcgagatcatagtcggaataagtgccttccaatttgatggcaccgacttgcgatgtataagctgtgatgctgattcctaactggcgaagggctaatttagccaatgcgccggctactacgcgtgaaatagtctcgcgggcagaagaacgtccgccgccgcgatgatcacggatgccgtacttcactttgtaggtgtaatccgcgtgtgaagggcggtatacctctttcaggttattgtagtcattggaatgttgattctcgttccaaacgataaatccgataggacatccggttgatttgccttcgaagatgcctgaaagaaactccactttatccgcttccttgcgtggtgtggtgaggatggattgtcccggacggcgtcgatttagttcttgttgtacaaattcttcgtcgattgtgattccggcaggaaatccgtcaattactcccccaactccttttccatgagactcgccgaagctggtgagccgaaagatgttgccaaatgaattaaacatagttgtggcttttttaaaattactctatgcaaatataacaaagtttttgataagaaggttgtgaattcaaaatatcttcggaaaaggaagcaaattgaaccttttttcctctttttagtttataaatgacgattatttaataactaaacccgaaaattatgaaaaagaatctattgtatttgtgggcattgatatgctctgtctctcttttgacggcttgtagcagtgatgatgataatacggtcaatgatgaaacgactcctccggaagaagaggctgtggtgactgctcccgatgtggtgggaacgtattggggaaatctcgatatttcaatgctgcccgatggctctgaccaggaagttgtgattgccgacggacttccgaagtttattactttctcccaggtcagtgatacggaagtaaagatggaactgaaggaatttgaactgtttataaacggaaacatattaaagttcggcgatatcgtgatagacaagtgtgcagtgaaaaaggaaacggacgtttcgactttcaccggacagcaagaccttacttttcagggggatgccgctgctctgggtacctgtgccaccagtatagaaggaacggtgcaaagtggaaatgctacaatgaatattcaggtaaaagtacctgcattgaagcagaccgtgaaagttgctttctccggtgtgaagcaggtggaggaatccggtaaggattaatccgtctttggtcagctagaaagcatatccgaatccgatattcaagtagatcggatacatagcaaaagtaatggtctgaaagtcatttctgaagatatcattcaatccccaggtgaggtctgcatatatattgagatgtttgaatgctctccatccggctcctatttgcaggccccactgaaaatgtctcaggtcgtccgagaagtcataagtagcgattttaccatccgtaaattcgactttggggcctacggggtcgccttcacgcaggtatccttcatatacgtgccccgaaaattctcttgaaagcagatacgaaaaataaggtccggctttaatattccaacggttgctcaacttgtaagtagccattagaggaattgtcagtccggaagtgtggactttggttttgactcctcctgtccagacaccgctgattctttctcctccctgtccgaggatttccatattatagtttttgacggtggcttccgttgtcatggctttattctccagccgcagccctacaatgactccgagcttgttttgaacggcaaaccatttggttacttctcctccgatgctgatagccagcgttgggttgtagccgtcaatcgaacggatttcgacaggcagcgggagcggggctgtaccgccgatgctgaaccctgctttgatttcatattccagtccgtgaagagcggaacggataagcgtttcgtttctgtcaacctgtgaatagccggggagggctattaccagacaggcgagtaaactgaatatataggaatggattttcatcttttcattattattaaatcattagttatttcattatagttgctctgttctgccttccatagctgctatcagatcgttggtcgaatggaatcagtcttccgagcgatagattagttcgacttcatcaatcaacaatgtacttccgatagctccgttaaaatgatctccttccaggctggaagtgaatacgatagctacattatactttcctgctgttagcttctctttatctatgtattttccggataacatatggaagggaagtttaaagtatgtccactcgtccgtctctttggcgtcgtcaatgcgtgctattgaaaccaggttgggactggtgaaagcattcgttccgtcaagagtcggcacagattcactggtctcatacatgatggcataaatatcgcatatatcccgtttgccactgacgggtttgccgccttctgtaaactgatctccggctttatacttgtaatagcctgccagataagttggtatatgccggaaaggcagaccgaatttggtcgctttcagtggattgctcattgcatttcctacatcaaaagagccgataaacaggttcccggctgcgataggcattcccataatgctaccgaagaatccggtactgcgggttactaaggacaggcattttccggtttttccgtttgcaaactgaaaagtcggatagtcgtcggctgtcttgggaactccggtcattgcataacctgcgtttccgctggcccattccatcaccactttttctccttcccgttctacgaagatgtagtatttctgtccgccgagcgtatcctcaaaattgtaaatagtagcaagttccgtatcaataacggatacggtgtacttcttcttccaaaagccatcggcagccgtaacggtatattgctgaggcgaatggaaatctctagccgtcccactgggaggatcgatagtggctcccggagtcaatgtaaattcgggtgcaagggatgaaatgtccgttcccggtcctacaaatatattgatggaattattagtgataatcggactcgttgtcatgactactcccggcaatctgcaactgagtatgtctgcctctgcattgggagcttcttcgcgaatgcaagaagaagagaaaatggctagcagcaaataaagaataccgtgttttgctttcatttttctactattctaactgttaaagttcggttcttggaagattttataacaatttgcaattttatttgttcactaatggatgtttgataaaaaagaattttctacttttgtggaaactaaagccttatagggtatgattgaatcggaaagaaaacagataatagacttgatcaaaaaagaggtgattccggcgatagggtgtacggaacccattgcggtagcgctttgtgtagctaaagctgccgaaacattaggaatgaaaccggaaaagattgaagtgttattgagtgccaatatattaaagaatgcaatgggagtcggtatccccggcacagatatggtcggacttcctatagctgtagccttgggagcgttgatcggccgatcggaatatcaattggaagtgttgagagactgcacaccggaggcagtagaacaaggcaaactgtttatcgcagagaagcgaatctgtatttctctcaaagaagatattacggaaaaactgtacatcgaagtaatctgcacagccggcagccaaaaagcgacggctgtgattgccggcggacatactgcctttgtctatatagctacggatgaaaaagtactgcttgacaagcaacagactgccaatgaagaggaagaagacgcttcactggaactgaatctgcgcaaagtctatgattttgccctgacatcccctctggatgaaatccgttttattctcgatacggcacgtctgaacaaagcagccgccgagcaagcctttaaaggcaattatgggcattctttaggtaagatgctccgtggaacgtatgaacataaagtgatgggtgacagcgtattctctcatatactatcttatacttccgccgcttgcgacgccagaatggccggtgcaatgattcccgtcatgagtaactccggcagtggcaatcagggcatatccgccacacttcccgttgtcgtatttgccgaagaaaatggtaaaaccgaagaggaactgattcgcgccttaatgctgagtcatctcactgtaatctatattaaacaaagtttgggacgtctctctgccttgtgtggctgtgtagtagctgccacgggttccagttgcggaatcacctggctgatgggtggaaactataatcaggtagcctttgccgttcaaaacatgattgccaacctgacgggaatgatttgcgacggtgcaaaaccgagctgcgcactcaaagtaacaaccggagtctcaacagccgtattatctgctatgatggcaatggaggaccgttgtgtgacttctgtagaaggcattattgacgaagatgtcgatcaaagcattcgtaacttgacaagaatcggctcgcaggccatgaacgaaacggataagatggtgcttgatatcatgacgcacaaaggaggatgttaacaggtaataagtaacaagtaataagtaataggtaatagctggaataacggcataaaaaaagtattaagtattaacttccgcctatatccgcatggaattaatacttaatacttattacctattacttaaaattagtggcagtgtccgccttcgcaaccgcagtcatcgccacagtcgctgccgcagctgtcgcatccgcaaccgcaaccttcaccgctcatcatcttcaccagttcctgaatttcttcgttggtagcaggacggctttcgattacttcaccttcaaagatcaggtcagcgcctgccaatgggtggttaaggtcaactactactacatccggtttgatttctacgacgctggcgtttacgcgttgaccgtctccggtcatcaaaggtacaatgctgccttctgttacgcgttcgctgtcgaacttgccatctatttcaaagatatttttaggaagatcaaatacatgttgctcatcgtaggctccgtaagcttcatctgccggaatggtaaaatcgaatttatcacccttagaaagagctgttatctggttctcgaagctttcgagcgttgtgcctaatcctgaaatgaactgaaaaggatgttctgcatttgtttcttcgaacaattctttttcaccatcttccactgtatatagcttatatgcaacggtgatgtacttgttttctactgtttccatctgatatttatagtttctaattaataaatcccttatttagggtggacaaagatacgaataatttgcttgctaccgggtgcatacggagtaaatttcagattattaagcgcttttgtcagaaatggacagtcattctctactaactgatagttgcaaattcaacctttaagtgataaaatttaggtttattaccgttcttttcttacgattattcgctttttagtgatttttttcttcgatttgtttggagataataaaaaagcccttacctttgcagcacgaaaataaagaaaagaagatatgaatatattacatacatctattaacctagcagttctgcatattattcgcgtcgtggtggtgccatcaagagcgtgagaaaggttttgtgtatgtattcgtaccataaaagatagaatttggagcctttctcactgatgtgagggaggctctttaattaaaagatagattgaaatgaaaaagcaattacgcagttcgtttagtacacaaggccgtcgcatggcgggagcccgcgcattatgggcagccaacggcatgaagaaaaatcagatgggaaaacccattatcgctatcgtcaattcgtttacacaatttgttccgggacacgtgcacctgcatgaaatcgggcagttggtgaaggcggaaattgagaagctgggatgcttcgctgcggaatttaatacgattgctattgatgacggtatcgctatgggacatgacggaatgctttactcgcttccttcccgtgatatcatagcggacagcgtagaatatatggtcaatgcgcacaaggcggatgcaatggtatgtatcagcaactgcgataagattaccccagggatgctgatggctgccatgcgcctgaatatccctaccgtatttgtatccggcggaccgatggaagccggagagtggaacggtcagcatctggacttgatcgatgccatgattaaatcggcggacgacagtgtaagcgatcaggaagtagcgaatatcgaacagaatgcctgtcctacctgcggatgttgttccggaatgtttacggcaaactcgatgaactgtctgaatgaagctatcggcttggctcttccgggaaacggcacaatcgtggctacgcacgaaaatcgtacgaaactgtttgaagatgctgccaaactgattgtggaaaatgcaatgaaatattatgaagaaggtgacgaaagtgtacttccccgcagcatagctacccgtcaggcattcctcaatgccatgacgctggatattgcgatgggcggttctaccaatacggtgcttcacctgttggccgtggcacatgaggcaggagtcgatttcaagatggacgacatcgatatgctgtcacgcaagacaccctgcctgtgtaaagtcgctccgaatactcaaaaatatcatattcaggacgttaaccgtgcgggtggcatcattgctatcctggcagagttggcaaaaggcggtctgattgatacttccgttctccgtgtggatggcatgtcgctggcggaagcgatcgatcaatattcaattaccagcccgaacgttacggaaaaagcaatgagcaaatattcaagtgcggcaggaaacagattcaatctcgtacttggttctcagggagcttattatcaggaattagataaagatcgcgcgaacggatgtatccgtgatctggagcacgcctatagcaaggacggaggcctggcggtactgaaaggaaatatcgctcaggacggttgcgtagtaaaaacggcgggtgtagacgaaagcatctggaagtttaccggacctgccaaagtattcgactcacaagaagcagcctgtgaaggcatcctcggaggccgagtcgtcagcggcgacgttgtcgtcatcacgcacgaaggtccgaagggcggtcccggtatgcaggaaatgctttacccgacttcttatatcaaatcccgtcacctcggcaaagaatgtgccttgattaccgacggacgtttcagtggtggaacttccggattgagtatcggacacgtttctcccgaagccgctgccggaggtaatataggaaaaatagtagatggagatatcatcgaaatcgacattcccgcccgaacgattaacgtgcgactaacagatgaagaactggctgcccgcccgatgactcccgtcacccgtgaccgttacgtgccgaagagcctgaaagcatacgccagcatggtaagctctgccgataagggagcagtgagattaatagactgatccacttcattatccattatgaatcatccattatccattaaagaactatgagtaaggacttaataacaggcgcagaggcaatgatgcgctctctggaacatcagggagtgactaccattttcggttatcccggcggttccatcatgcctacgttcgatgccctgtacgaccatcaaaatacattgaaccatatcttggttcgccatgaacagggagctgcccatgcggcacaaggctacgcccgtgtatcgggtaaagtcggtgtttgcttggtgacaagcggccccggagcaaccaatacgatcacaggtattgcagatgcgatgatagacagtacgcctatcgttgtcattgcaggacaggtgggaacaggcttccttggaacagacgcttttcaggaagtcgatctcgtaggtatcactcagccaatcgctaaatggagctatcagattcgccgtgccgaagacgtagcctgggcgatagcacgtgctttctacattgccagtagtggtcgtcccggtccggtggtactcgactttgccaagaatgcgcaggttgaaaaaacaaaatacgagccgacgcagcaggagtttatccgcagctatgttccggttcccgatacagacgaagaatcggtaaaggctgccgccgaactgatcaataacgccgaacgcccgcttgtcttggtaggacagggagtggaactgggaagcgctcaggaagaactgcgtatctttatcgaaaaggcggatatgcccgcaggttgtaccttgctcggactttccgcattgcctaccgaccatccgttgaataaaggaatgctgggtatgcacggaaatctgggaccgaatatcaatactaacaaatgtgatgtactgattgctgtcggtatgcgtttcgacgaccgtgtgaccggtaatctggctacttacgccaaacaagcgaaagtgatccattttgacattgatccggcggaagtaaataagaatgtaaaggtagatattgccgttttgggcgactgcaaaaagacgctggctgctgtgaccggactgttgaaaaagaaccggcacaccgagtgggtcgatagtttcaaggaatatgaagcggtagaggaagaaaaagtcattcgtcctgaacttcatcctgcaacggattcactgagtatgggcgaagtggtgcgtgcggtaagcgaagcgacccgtcacgaagccatattggtgacagatgtaggtcagaatcagatgatctctgcccgctactttaaatataccagggaacgtagtatcgttacttcgggtggactcggcacgatgggttttggccttccggcagctatcggagctactttcggccgtcccgaccgcactgtatgtgtatttatgggtgacggcggactgcaaatgaacattcaggagctgggtacgatcatggaacagaaagctccggtgaagattatctgcctgaacaacaattatctcggcaacgtgcgccaatggcaggctatgttctttaatcaccgttattcatttactccgatgctgaatccggattacatgaaaatcgcttccgcctacgatattccttccaaacgtgtcttttcacgggaagaattgaaagtggctatcgacgaaatgctctcgacagacgggccgttcctgctcgaagcctgtgtggtagaagaaggcaatgtcctcccgatgacccctccgggcggttcagtcaatcagatgttgctggaatgttaatccttaatttagaaagttatgagtgataagacattatatacgattatagttcattctgaaaatatagccggattgctgaatcaggtgaccgctgtatttacccgtcggcaaataaacatcgagagtttgaacgtttctgcttcttccattaaaggagtacataaatatacgatcacagcgtggactgataaggacactattgaaaaggtggtgaagcagatcgaaaagaagattgatgtgattcaggcgcactattttactgaagacgagatttatttccatgagatagccttatataaggtatctactcctgcttttcaggagactccggaagcatctaaagtgatccgcagatataatgcccgcattgtagaggtgaatccggtattctctatcgtcgagaagaacggcatgagtgaagagattacttccctttacgaagaacttcgggctttgaaatgtgtgctgcagtttgtccgttcgggccgtgtggctattactaccagctgtttcgaacgtgtgaatgagttcctggacggacaggaagcgaagtataagcaaagtaaaaaggaacaggagtaatgagtgaagaaaataaaatagggacttatcagtttgtggcagagccgtttcacgtagattttaacggccgcctaaccatgggcgtgctgggaaatcatctgttgaattgcgcaggttttcatgccagcgaccgtggatttggtattgctacgctgaacgaggacaattacacatgggtgctttcccgtctggcgatcgagctggacgagatgccttaccaatacgagaagttctcggttcagacatgggtggagaatgtctatcgtctctttaccgaccgtaactttgccgtcattgacaaggatggaaagaagatcggctatgcccgttccgtatgggcgatgatcaatctgaatactcgtaagcctgccgatctgttggcattgcatggaggaagcatcgtcgattatatatgcgatgaaccttgcccgatagaaaagccttcgcgtatcaaggtgacaagcaatcagcctgttgcgacgctgacggcaaaatacagtgatatcgatattaacggacacgtaaacagtattcgttatatcgagcacatacttgacttgtttccgatagaactgtatcagacgaaacgtatccgccggtttgaaatggcgtatgtggctgaaagttatttcggagatgaactctctttcttctgtgatgaggtgaatgaaaacgagtttcatgtagaggtgaagaaaaacggcagcgaggtagtatgccgttccaaagtgatatttgaataatatagagtataaaatcaattaataacagatggcgcaagtcatcaaaacaaaaaaacaaaaaaaatggcacagttgaattttggcggaactgtagaaaatgtagttatccgtgatgaatttccattggaaaaagctcgtgaagtattgaaaaatgaaacaatcgctgtaatcggttatggcgtacaaggtcccggacaggctctgaaccttcgtgataacggtttcaatgtaatcgttggtcaacgccagggaaagacatatgacaaagcggttgctgacggatgggttccgggtgaaactttgttcggtattgaagaagcttgcgaaaaaggtacgatcattatgtgcctgttgtctgatgcagcagtaatgtctgtatggcctactatcaagccttacctgactgcaggaaaagctctttatttctctcatggttttgctattacatggagtgaccgcacaggtgtagttcctcctgcagatatcgacgtaatcatggttgctcctaaaggttcgggtacatccttgcgtactatgttccttgaaggtcgcggcttgaactcttcttacgctatctatcaggatgcaacaggcaacgctatggacagaacaatcgcattgggtatcggtatcggttcaggttatttgttcgaaacaactttcatccgcgaagctacttccgacctgacaggcgaacgtggttcattgatgggagctatccagggtctgttgctggcacaatacgaagtgttacgtgaaaacggtcacactccttccgaagcattcaacgaaactgtagaagagctgactcagtcattgatgccgttgtttgcaaagaacggtatggactggatgtatgctaactgctctactacagctcaacgtggtgctctcgactggatgggccccttccacgatgctatcaaaccggtagttgaaaagttgtatcacagcgtgaagactggtaacgaagcacagatttcaatcgactctaactccaaaccggattatcgtgagaaactggaagaagaactgaaagcattgcgcgaaagcgaaatgtggcagactgccgtgacagttcgtaaacttcgtccggaaaataattaatcagacttatactatataagtttttcaaaaggcgggaaaagcgtattttcccgccttttctatgtagataccggtcttttgagtaatagaaaaaggatgaaagtagaaaaaaaaattaaaagatactgataatataggtgaaaaagagcatttatgattacctttacggcaacaaataaaacagaataggcaatgaagaaactttttacttacagaagatcgatacgtatgaagatgatttcttctttaataaatagtatatcagaatgttacattaaaagatatttaagttattctctaccgaatggtagctgtaataccatttcaagtcctttttatatttcgtgttccattagtgattcgttgatatgatgcagaattttattctgtagcaggaaaaagtatgcgttaaattgaatttaagacagagcttttggaacagaatttagtgggaaaataacattgtttgttttgtttgtaaatgggagtcctctttcgtgagaaagggggcttctttttttatcccgatgattcaggaggataccgcttcctgccggatatactgtatcagtttccggtagaacgcatgcttggtaagagtggttgcatctcccaaaatcacaagtttcatccgggcgcgggtaatggctacgttcattcgtcttaaatcattcagaaaaccgatctgtccgtcctcgttcgcccggacgaggctgataaagacgacatcccgttcctgtccctgaaagccgtctaccgtgttgaccgtgatgaggctgcggaaagggcggagaaaactgcttcctctgattttacttctcaggtattgcacttgcgccttgtagggcgaaatcagaccaaagtcgatgctctcgtccaggatgcgtgctttgccgatccggctgatataggcttccagttcttgcagtaacaagttggcttcctgcttgttgatgcgcccgaagctctcgcctacaaactcttcgtggaagtccatttccgaggtatctatccagttcatgggagtgtcgaagtcaaggataccccggttgcgcacttccggtgcggcttccagttctccgttgtagaaccattcggagggaaagcgcatgattgcctcgtgcatccggtattgcactttgagtagcgagacggcagaaggtttttgctgcacgactttttccattaaagtatggtccagtccgccacgggcggcttcgatacatttgattgtaggagggagctggcaatggtcgccggcaagaatcacacggtcggcctttcggatggcgatccaacaggcggcttcgagtgcctgggcggcttcatcgataaataaggtggggaaacgccgtccgttgagcaaacggtgattgctgctgaccagcgtggaagcaatcacacgggcactgtcgaaaagatcggcgttgatcaggatttccagttcggtggcacggtcgcggaggcggctcatccggctgcgcattccttccctttcggagtaacttccccgacgcatccggctgcccatttcacggatcgattttcggattccccaaagttcggggtaggccgaatgattctcaaagcggcgttcgtaagtgaaagaaagcattttgtcattaacacgtgtagggttaccaatgcggaggacaggcacaccccggtctaccagtttctcgcaaatccagtccacagccgtattactttgggcgcagaccagcacctgcggttcgcggtgaagcgtttcgtaaatggcttccacgagcgtggtagtctttccggttcccggagggccgtgaacgatggcgacatcgcgtgtgcataacactttgtttacggctgtttcctgcgtgctgttcagccacgggaaacggacgggatataattcgcggaatcccggcttttgtgttcccagcaaggtgtcccggagttcggcaaggcggttgcccttagcgcggattgtgtcttccagcgcttcgaacatggcacgataggacgtttcatcgaaataaagttgtacacccagcacctcttccgtttgcagttccagtaaggcgcccgcactgggaagcacgaccaccatccgttcgtcgtccgcataactcaccgttgcaatgaaattcatgtaattcacttttccgtcaaatgactgccggaaaaagcagacgggacgaccgaattcgaaggaatgctcgatttctttattttcggtgcgtgtaatatctattacaagttgatttagagaattatagtaacttcgaccgggagaggcgggataccagcacagaccacgtttcactttgcgggcgacacccattgtttcagtctgccgcttgaattcctccttttcgtgttcatactccatgcgtagcaggagttgctgttgctgaaggtcgatgattggacttttcggatgattattcataatagatgcaaaggtagtaaatcttcctcctgagacgaaaatatatttcattttgttaaacattcctcgaacgccgttcgttatttttatagatagactaaaaaaaataaaagcaatatggtgtatgatttgactatgttagaggctttttattctgcttataaaggaaaagtggaacacgtgcgggctgttttgaaacgccctttgacgttagccgagaagattctgtatgcccacctgttcaatgagggcgatgtgaaaaactacaaacggggtgaagactacgtaaatttccgtcccgaccgcgtcgctatgcaggacgcgactgcccagatggcattgcttcaattcatgaatgcaggaaaagaaaaagtggctgttccctccaccgtgcactgtgaccacttgatacaagcgtacaaaggagcaaaggaggacattgctacggcaaccaaaacaaacgaagaagtttacgactttttgcgcgatgtatcctctcgttacggcatcggcttctggaagccgggcgccggaatcattcaccaggtagtgctcgaaaattacgctttccccggtggaatgatggtaggcaccgactctcacactccgaatgccggaggattgggcatggtggccatcggtgtcggcggtgcggatgccgtagacgtgatgacaggtatggaatgggaactgaaaatgccaaggattatcggtgtccgcctgaccggaaaattgagcggctggacttccccgaaagatgtcatcctgaaacttgcagggattctgaccgtaaaaggaggaacgaactccatcatcgaatatttcggaccgggaacggcttccctgtcggctaccggcaaagcgaccatttgcaatatgggtgcggaagtaggagctaccacttcgcttttcccgttcgacgggcgcatggctacttatctgagagccactggcagagatcgtatcgtggaactggcggaagccgtggactgtgaactccgtgcggaccaacaggtgacggacgaaccggaaaagtactacgaccgtgtcattgacattgacttgtctacgctcgaaccttacatcaacggccctttcacaccggatgccgctacccctatctctgaatttgcagaaaaagtattactgaacggctatccgcgtaagatggaagtcgggctgatcggttcgtgtaccaactcttcttaccaagatctcagccgtgccgcatcccttgcaaggcaggtgaaggaaaagaatctgagtgtggcttccccgctgatcatcaatccgggttccgaacaaattcgcgccactgccgaaagagacggaatgatggatgacttcgtgcagatcggcgccgtgatcatggcaaatgcctgcggtccttgcatcggtcagtggaaacgtcatacggacgactcgatgcggaagaactcgatcgtcacctccttcaaccgcaactttgccaaacgtgcggacggcaatccgaacacatacgcctttgttgcttctcccgaactgacgatggcactgaccattgccggtgatctttgcttcaatccgctgaaagacagactgatgaatcatgatggcgaaaaagtgaaactggccgaaccggaaggcgaagaactccccttgagaggatttacctccggtaatgaaggctatatcgcccccggcgggacgaaaacagcgatcaacgtcaacccggcttcccaacgcctgcaactgctgactcctttccccgcttgggacggacaagatatactcaatatgcccctgctgattaaggcgcagggcaaatgtactaccgaccatatttcgatggcgggaccgtggctgcgttttcgcggacatttggagaatatttcggataatatgctgatgggagccgtgaatgctttcaatggcgaaacgaacaacgtgtggaaccgttcgacaaacacctacggaaccgtttcgggcacagccaaaatgtataaatccgaaggaatcccctccattgtcgtggctgaagaaaattacggagaaggctccagtcgcgagcacgcggcaatggaaccccgtttcctgaatgtgcgtgtgattctcgccaagagcttcgcccgtatccacgaaacgaatctgaaaaagcagggcatgcttgcccttacctttgcggataaagcggattatgacaagatacaggagcacgacctcctttcagtcatcggcttgcccgactttgctccgggacggaatctgaccgtcgttcttcatcacgaagacggaacgaaagagagttttgaagcgcaacatacatacaacgaacagcagattgcctggttccgtgccggctctgccttgaatgccagataattaaaatgatagaaatgaacaaaataaccatgcaaaaagatggtacgctgtcggtgcccgatgtgcctgtcgtaccttatattaccggagacggagtaggagcggaagtgactccgtcaatgcaagccgttgtgaacgcggctgttcagaaagcatacggcggcaaacgtcggattgaatggaaagaagtgctggcgggcgaacgcgctttcaacgagacaggctcttggctgccggatgaaacgatgaaggctttccaagaatatctgatcggcatcaagggtccgctgacgacccctgtcggcggtggaatccgttctttgaacgtagctttgcgccaaaccttggatttatatgtttgtttgcgtccggttcgttggtatcaaggcgttcattctccggtgaaagcaccggaaaaagtgaacatgtgtgtgttccgtgaaaatacggaggatatatatgcaggaatcgagtgggaggcaggtactcccgaagccgaaaagttctatcaattcctgaaaaacgagatgggagtgacgaaagtccgcttccccgagacctcttcttttggggtgaaacctgtttcccgtgagggcacggaacgtcttgtgcgggctgcctgccagtatgcgctcgaccatcatctgccttctgtgacactggtgcacaaaggaaacattatgaagttcaccgaaggaggtttcaagaaatggggctatgagctggcgcaacgtgagtttggcgacgcgctggcagacggccggctggtgataaaggactgcattgccgatgcttttctgcaaaatacattactgattcccgaagagtattccgtgattgccacgctgaacctgaacggagactatgtttccgaccagttggcggcaatggtaggcggcatcggcattgctccgggagcaaatattaactacaagacggggcacgccatttttgaagcgactcatggaaccgcccccaacattgccggaaaggatgtcgtgaatccttgttctatcattctttcggcggtgatgatgcttgaatatctgggatggaaagaagcggccgcgcttatcgaaaaggcgctggaacagggtttcctcgatgcccgtgccacgcacgatctggctcgctttatgccgggaggtacatccctgtctaccaccgctttcacacgcgaaattgtggaaagaatcgaaaagtaaatgtaacgattaaaaacgaagtattatgaagaaagagtatttgatttacaagctctccgaggagatgaaagaggcaacccggattgacaatgaattgttccccaagtttgacgtgaagcgtggactacgtaatgaagacggcaccggtgtattggtaggtctgacaaagattggtaatgtggtgggttacgaacgtatccccggcggcggtctgaagcctattccgggaaaattgttctatcggggctatgatgtggaagacatttctcacgccatcatcaaggaaaaacgtttcggcttcgaagaagtggcttatctgctactctccggtcgtctgccggacaaggaagaactggcttcgttctgcgaactgatcaatgacaatatggcgctcgagcagaagacgaaaatgaatattatcgagctggagggaaataatatcatgaatatcctttcgcgcagcgtactcgaaatgtatcgtttcgatcccgatgccgacgatacttcccgcgacaatctgatgcgccagagtatcgatcttatctccaagttcccgaccatcattgcgtatgcttataatatgctccgccatgctacattcggccgttccctgcatatccgtcatccgcaggaaaaactctctattgccgagaatttcctctatatgctcaaaaaagattatacggaactggatgcccgtacgctcgacttgctattgattttgcaggcagaacatggcggtggtaacaactcgactttcacggttcgtgtgacttcttccaccggaacagatacatattcggccatcgccgcaggtatcggttcgttgaaaggcccgcttcacggaggcgcgaatatccaggtggccgatatgttccatcacttgcaggagaacatcaaggactggaagagcgtggacgagatagatacctatttcacacggatgctgaataaggaagtgtataataagaccggactgatttacggtatcggtcatgctgtttatacgatttccgatcctcgtgcgctgttgctgaaagaactggctcgcgaccttgcccgtgagaaaggaaaagaagaggagttcgctttcctcgaactgcttgaagagcgtgccatcgctactttcggacgtgtgaagaacaacggaaagacggtttccagcaatatcgacttctattcgggtttcgtatatgagatgattggtttgccgcaggagattttcactccgctgtttgccatggctcgtattgtcggctggtgtgcgcaccgcaatgaagaactgaacttcgagggcaaacgcattatccgtccggcttataaaaatgttcttgatgatctggcttatatccccatcaagaaacgctgataagaacaaatccttttatgcaataataactaacctcagacgtacatctcggcaatccctgcatgtacgtctcggtaatccccagttgtacatcttggtagtacccggttgtacgtctggggtgacttgtttcaggaagaacgtccgatgttcatttaacatttaacactttgcggctgctgtatttttcatccgatggaggctaaggcatttatcgttggtagaaagggcacagcctggcaggtagaaacgcccttttaacgctacgttaaaagggcgtttctacaaccgatgaattatacattctatttctttggatatcagtgaactatgaactttccctttaccggaggagagattatggcaggtgacctgttgagaacgaacttgttattttaataattaccgttgattgaatctttgctgctattattgggataaggcataatgtctattaaatcaaaatacattaagcgtgtttttagatgcgttccggtttcaaagcctgtatattccacttcttgcgcttccgtagagaaaaggtatttgaaaccgtttttcagataatagttcagaggaatattttcattgtaagcgtcaacaattaaaaagcgacaccctgttttgtttcctgcatcaatgaaccatgatttaatgaaagtcatcagatcactgcctatgccctgatgcttgtattctttattgattccaagtctgccgattaatacacccggatagcggcgcatttgtttggcacggggaatggctttctgaactttcttttccctgctgttggggaggatgtttactctgatactatcgttagaaacagtgaaggcacatactatgtccgaaggctttttatctgaacgaaaacagtaactttttcctaatagttgtgcattatagagaggagcatcgttatgaaagaagtcgtctaagtcttggtgcccgcatgagaaagggtcacattctttaatcgtatactcatcaagtacggcaaaagtacatttctcaaaaagaaatcccatgttttataacattttagcctttttgagcacagcacgggcttccagcacatgtttgctgaagtcttgtttgttttgatttttataagccttgtccgctgccttaacgaagtgttccgcttcttttccttttaaggtcggtatggctttaatttccattgccattgctttttctttttatttagttcataaccaactgcaaagatagctgatttttaatgaataaacaaagaatgccggaagtctgttgtcatttgatttgttttttatttgagttatttttgtggccattcttttctttttttgttatttttgtgaatctcaaaagaaaatcaagatgagtataactgcctttaatctatttttgggcgtcatgagtctgatcgctctgattgttttcatcgccctctactttgtgaaagccggttacgggatatttcgcactgcctcctggggagtcgccatttccaacaagttggcgtggatactgatggaagcccccgtatttctggtcatgtgctggatgtggatgcactcggaacgtcgttttgatccggtcatactgacattctttatcttctttcagattcattattttcagcgcgccttcgtctttcccctgctactgaccggaaagagcaaaatgccgctggcaattatgtcgatgggaatcctgttcaatctattgaacggctatatgcagggcgaatggatattttatctctcacccgagggaatgtatcattccggctggttcacttccgcatggtttattgcgggcagtctgcttttctttgcaggtatgttgatgaactggcattcggactatatcatccgtcatttgcgcaaaccgggggatacccgtcattatctgccccaaaaagggatgtaccgctatgttacttccgccaattatctgggcgaaatcatcgaatgggcaggctgggcaatactgacctgttcactgtccggacttgtattcttctggtggacagtggccaatctcgtcccccgtgccaatgcaatctggcatcgctaccgtgaagaatttggctcggaagtaggcggacgcaaacgtgtatttccttttatctattgatttgaaataaattatctattgacataaaatagcgtactatggaatctaaacttttcacccctgtcactttcggtccattgacgctgcggaatcgtacgatccgctctgccgcttttgaaagcatgtgtcccggtaacgccccttcacaaatgctgctcgattaccaccgctcggtggctgcgggcggagtcgggatgacaactgtagcctatgcagccgtgacgcaaagcggactttctttcgaccgtcagttgtggctgcgtccggaaatcatttccggtttacgtgaagtgaccggagctatacacacggaaggtgcggcagcaggcatccagatagggcactgcggaaatatgtcccataaaaagatttgcggaaccactcccatttcggcctctaccggtttcaatctctattctcctacattcgtgcgtggcatgaagagagaagagttgccggagatggccagggcctacggacgggctgtccacttggcacgggaagccggcttcgacgccgtggaggtacatgccggacacggatatctgatcagccagttcctgtctccctacaccaatcaccggaaagacgaatacggcggctcgctcgaaaatcggatgcgctttatggaaatggtgatgaacgaggtgatgacagcagcgggaagcgatatggcggtctttgtaaaaatgaatatgcgcgatggcttcaaaggcggcatggaaaccgatgaaaccttgcaagtggccaaacgcctgctggcattgggcgcgcacgcattggtactgagcggaggcttcgtcagcaaagccccgatgtacgtcatgcggggagcgatgccgattcgttcgatggcttactacatggactgctggtggctgaaatacggggttcggatgtttggaaagtggatgattccgaccgttcctttccgggaagcctatttcctggaggatgcactgaaatttcgggcggcacttccggaagctccgttgatttatgtgggcggactggtgtcccgcgaaaagatagatgaagtattggatgccggcttcgatgccgtccagatggcacgtgcgttgctcaacgaaccggagtttgtcaaccggatgaggcgggaagagcaggcacgctgtaactgcgggcacagcaactactgcatcgggcgcatgtacactattgaaatggcctgccaccaacatttgaaagaaaagctgcctccctgcctgcaacgggagattgaaaaactggaaaagcaatgagtgaagagaaatgggcaatcatcaccggtgccgacggcggcatgggaacggaaataacccgtgccgtagccgaagccggttaccatattattatggcttgctatcgtccgtccaaagcggaaccgatacggcagcgtctagtgaacgagacaggaaacgcaaacctggaagtcatggcagtcgatctgtcttctatggcatcgacagcttcttttgccgatcggattgtggagcgtcatctccccgtttccctgctgatgaataacgctggaacgatggaaaccggacttcacatcaccgacgacggctttgaacgaacggtcagtgtgaactatctggggccgtacctgcttacccggaaactccttccggcattgacacgcggagcccgtattgtaaacatggtttcttgcacgtatgcgatcggacacctcgattttcccgatttcttccggcagggaagaaagggaagtttttggcgaatccctgtttacagcaatacaaaactggctttgatgctgtttacgatcgaactttcggaacgcctccgtgaaaaaggaatcactgtcaatgccgccgatcccggcattgtttctaccgacatcatcactatgcaccagtggtttgaccctctgacggatatctttttccgcccctttatccgcacgccgaagaaaggggcttccactgctgtcggcctcttgctggatgaggcagtggccggagtcagcggacagctttatgcaggcaatcgtaggaaagagttgtcggacaactacatttatcatgtgcagaaagaacagttgtgggaaatgacggagcaattgctggcgcagtggttcacatgatttaatcatttgggtaatcgtacgtgcatctgatcgttattcatttgatgcagtgcaaatgatgaataagaaaaaacgtgaaaaaacgaccattctttcttctgccggagaaggagaaaaagaaatcacttggaattctgtgatcaatccgaaaaaaacggttgttgccgtttgttccttttatacggatttgagccaaatgttagtcaatagtatcttaaatggggtgactaaaaagtcggtagtatctccattggagatactactgtttgattcattcgtttcattcatttttcattcggatagagcaaaacaaggggtcggactgcccggaatctgtggcatggatcatggaatggatgaattgaaataagaacggtgaacaattgaaaagctcaattcgtccaccgttctttatattgcctttataaaaataagcttctgttctgttggcagtctctattaaatagaaagctctttcaatacattgaccagatctctcttgaccggcttatcattcttgatagctttgctgaatggtacataaacgatttcatcgtgctcgatacctatcattacgttgcgctggtcttccatgatagcgtcgatggcagcggcacccaaacggcttgccagaatgcggtcgtgagctgtagggcttccaccgcgctgcaagtgtcctaagattgtcacacgcacatcgtattgcgggtattcgtttttcacacgttccgcatagtgcatggcaccgcctgtcagttcgctttccgctaccagtacaatactgctattcttggatttacggaatccgttcttgataaattcttccagttggtcgacttccgtgctgaactccggaataatggctgcttcggctcccgaagcaatggcgccgttcagagcgaggaatccggcatcacgccccatcacctctacaaagaacagacgttcgtgtgaagtggcggtgtcacggattttatctactgcatccagaatggtgttcaatgccgtatcgtatccgatagtggtgtctgtgccgtaaaggtcgttgtcaatcgttcccggaagtccgatacatggaacatcgaattcctgtgcgaagattcgggcgccagtcagcgaaccgtcaccaccgatgatcaccaaagcatcaatgccttctcttttcatattatcataagccagctggcggccttccggtgtggtgaactccttacagcgggctgttttcaggatggttccacccagttggatgatattacttacgttctggctcttgaactctttgatttcgcctgtcaccagacctttgtatcctctatatataccttttacttgtagtccgttgtagatagctgcacgtgttactgcgcggatggccgcattcattcccggagcatcacctcccgaagtcaaaataccgatacatttaactgttcccataacaatctttcattaattagtttgacgtggcaaatgtacaacaaaaagttgaaagcagtgtttcataagttttttttcgtgtgtcgaaaccattaaaaatattcaaattgtcttttctatctttctttttaatcttttatcaatagctggatatggtcatgtattttttccatcagccatttgggggtggaagtcgctccacatacgccgatggattccacattccggagtaaagtgggatcgatttctttctcattatcaatcagatgtgagttggcgtttactttcaggcattcttcaaaaagcatttttccgttcgaactcttctttccgctgacgaagaaaatcagatcatgcgttgccgcaaattccctaagattgggcatacggttagctacctgccggcagattgtatcgtaatattcgaaagtggcatccggtgaaatgtggagtttgatgtattctacaatctcctgaaactcgtccagagactttgtggtctgtgagaaaaggcggatgcttttagtgaaatccagctttttggcttcttctgcactttcgatgacaatggcttgaccaccggtctgccctaccagtcccagcacttctgcatggccgttcttgccgtagatcacaatttgcttttcttcaaaatcttccttccggaactcttgtttgatgcgcttttgaagccgcagtacgaccggacaggttgcgtcgatgatttcgatattattcttgtgggcgatctggtaagtctccggtggctctccgtgtgcgcgaagcaacactttggcattgcgcaattgtctgaactcatcacggttgatcgtaattagtcccattgccttcagcctttctacctcccggctgttgtgtacaatatctcccaggcaatagagggtttctccttttgccagttcttcttccgccttgtggatggctgtgaccacaccgaagcagaagccggaaccttcatctatctctactttaatcatacactcgatttttatcctctattcctttactacttttccgaactgttccgacagccattccttctgctgttcgatgctcagattagaattgtcgagcagcagagcgtcatctgctttgcgcaatggactcacttcacgatgctggtcgatgtaatcccgttgctttacgttctcaagaatttcttcgaagctgccttcctggccttttgcttttagttcgtcaaaacggcgttgggcacgaatctccggtgtggccgtaacaaatattttcagttccgcatccgggaaaaccgtggttccgatgtcccgtccgtccatcacaatccctttttctttacccatggcctgttgctgtgctaccatcgcttcgcgtacaaaatcgagtgcgctgatagggctgactttggacgaaacccccattgtacgaattttattctctacgttcaccccgttgaggtaggtgtccggacgtcctgtctccggatttgggcggaaagtaatccggatatcccggattgcttctttcagcttctccgtatcgataacgtctccgttaaatatcccattttcaatactatataaggtgactgcgcgatacattgccccactatctatataaatgtatcctacttcgcgggcgagatctttggccattgtactttttccgcaggaggaaaaaccgtcgattgcgattgttatctttttcatattatctgcttcttatatttgtccgccaaagatacgcttattttgaaaatcagccataaatttgactgtaaaagcaactgaatgagtatgaaagaattaaaaaagttaaaaagccggataaaaagatacgaagaaacggacggttatctgaaaatgtagtatatttgcccagagacacataggaagacacttttttttattaatcattatattaacaaaattatggaagttaaaaaatcacccaaggcagacctggaaggaaagaaatccacatggctgctgatcggttacgtggtggtattggcttttatgttcgtggcgttcgaatggacccagcgtgacgtgaaaatcgatacaagccaggctgtagctgatgttgtttttgaagaggaaatcattcctattaccgaaacccctgaacaagcgactccaccaccacccgaggctccgaaggtggccgaattgctggaaattgtcgatgaccaggcagatattgaagaatcaactaccatccttaatgaggataacacacctaaagtggaagtaaaatacgtaccggtacaagtagttgaggaagagccggaagaacagactatcttcgaagttgtagaaaacatgccggacttcccgggtggacaggcagcattgatgcagtatctggctaaaaatatcaaatatccgactatcgcacaggaaaatggtactcaaggccgtgttatcgtacagttcgttgtaaataaagacggtagtatcgtagatgcaaaagttgtacgcagtgtagacccgtatctggataaagaagctctccgtgtgatcaacacgatgccgaaatggaaaccaggtatgcagcgtggtaaaccggttcgcgttaaatttacagttcctgtaatgttcagattgcagtaatttgtaacactcatacatttaagaggctgcgaatgcagcctctttttattcattaatctttgttttcatcatgtttacagcttctcaattacttgataaaataaacaaccacctatctgaaaatcagataacccggactccggaaggactctacgaaccaatcgaatacatcctttctttgggggggaagcggattcgtcctgtattgatgctgatggcatataacttgtataaggaagatgtttcgtcaatttacgatcctgctaccggtatcgaagtttatcataatcatacattgctgcatgatgatttgatggatcgttcggatatgcgcagaggaaagccgactgtgcataaggtttggaacgataacacagctattttgtcgggtgataccatgctgatactggctttccggtatgtagccggttgtgcgcccgagcatttgaaagaagtcattgatttgtttagtctgactgcgttggaaatttgtgaagggcagcagttggatatggaatttgagtcgcgcaacgatgtggcggaagacgaatatattgaaatgattcgtctgaaaacggctgtattgcttgccgcaagtctgaagatcggcgcgattctggcaggagcgtctgccgttgatgcggagaatctttataattttggtatgcagataggggttgcattccagttacaggatgatttgctggatgtttatggcgatccggaagtgttcggaaagaaaatcggtggagacatcctttgcaataagaagacatatatgctgatcaaagcactggaacgtgcaaacggagaacagctggaagaactgaaccgctggctgaatgcagagaactgtcagccggcagaaaagatagcggcagtgacggagatctataatcagttgactatccgtagcgtttgtgaaaacaaaatgcgcgaatattatacgctggctatggagagccttgaagcagttgcggttgccgaagagaagaagaaagaacttaagaatttagtgaaattactgatgtatcgggaaatgtagtaaagttggtgggaaatgccttacagacgattgccaaatacggatcaagccagagtacgggcgctgaaagcagcggtcgagaagggtgacgtgtataatgtgcgggacttggctatctcactgaaaacattattcgaagcccgtaattttctgctgaagtttgaagctgcgcagatttactatacccaatgttatgacaaccagtcgagagccagtcgcaagcatcaggcgaatgtgcggatggcacggctgtatatatcccattttattcaagtgctcaacctcgcggtgcttcgcgatgaaatcaaaccggtgcataaagaactttatgatcttccggaagcgaatgtggtaccggatttattaagtgaagcagctttggtagagtgggggagaaaaatcattgaaggagagcagcggagaacctctcaagggggaatccccatttataacccgactattgcgcgcgtaaaagtgcattatgatatttttctggatagctacgaacgtcagaaaaattaccagtctgccaccaaccggagtctggatgaactggcttcgatgcgtgaccgggcggatgaattgattctggatatctggaatcaggtggaagcgaagtttcaggaagtgaatcctaatgaagcccggttggcaaaatgtcgtgactatggactggtatattactaccgctccaacgaaaaagtaaaagaagaaagcgaattgtcatgttaatagatactcattcccatctttttttagaagaattttccgatgacctgccgcaggtgatggaacgtgcacgtcaggcaggtgtttcgcgtatttatatgcccaacattgacagtacgacgattgaacccatgctgtcggtttgcgcggattatccggatttctgttatccgatgatcggactgcatcctacctcggtgaacgagtcataccgtcaggaactgtcaatcgtccgggagcgtctggaagcacccaataactttgtagccattggcgaaattgggcttgatttgtattgggataaaacctttctgaacgaacaactgtacgtttttgagaaacagatagaatgggcgctcgaatataaattgcccatcgtggttcattcgcgggaggcattcgactatatatataaggtaatggagccctataaaaacactgctttgaccggtatttttcatagtttcaccggaaatgcggaagaagcggcccggttgcttgaatttggcggtttcatgttgggaatcaacggagtggtcacttttaaaaagtcctcactgccggataccttgctgacagtgcctttggagcggattgtgctcgaaacggattcaccgtatctgaccccggcccccaatcgggggaagaggaatgaaagtgcgaatgtgcatgatacgttcctgaaactggtagaaatttatcggaccaccccggagcacctttcacaagccacttccgaaaatgcgctaaaagtgttcggaatggtcaaataaggttccaaaggttttaaattatattaatttgcagtatttatttaagataaaaaagggataatgctttaggaaaagaaaaaaaaggatacatttgtagctgaaaatgcggaaaactcataaggagaggtgctcgagtggttgaagaggcacgcctggaaagcgtgtatacgccaaaagtgtatccggggttcgaatccccgtctctccgcagaacaaaagttgaaacgtgaagtaaatacaataaataataatcaattaattaatcttaaaaattagacacacaatgaaaaagttatttgcaattgttgctgtgattggggcctttacatttggctcaattcaacttgctcaggctcaagacgctcctgcagcagaacaaactgaacaacaagctgctcctgctgctgctcaagctgctccggccgctgctcctgctgcagaagaaggtggtattcacaaagaaatcaaagttaaattcatcgaaggtactgcatctttcatgagtttggttgctattgctttggttatcggtttggctttctgtatcgaacgtatcatctatttgagcttggctgaaatcaacacaaaaaaattcatggcatctatcgaagctgctttggaaaaaggtgatgttgaagctgctaaagacatcgcacgtaacaccagaggtcctgttgcttctatctactaccagggtttgatgagaatcgaccaaggtatcgatgtagttgagaagtcagtagtatcttacggtggtgtacaggctggttaccttgaaaaaggatgttcttggatcacactgtttatcgctatggctccgtcactcggattcttgggtactgtaatcggtatggtgcaggcatttgataagatccagcaggtaggtgatatctctccgacggttgttgcaggtggtatgaaagttgccttgattacaactattttcggtttgatcgttgctttgattcttcaggtattctacaactacgtacttgctaagattgaagctcttacaagcgaaatggaagactcttctatctctttgcttgacatggtaatcaaatatgatctgaaatacaaaaaataattcgaaatgagtaagttatcatataaagtatcgtattacgcactgtatgcgatgtttgccatcatcctcattgtcctggggcttttctacctgggtggtgatgctcaaggagcagatgtcattgcgggagtagatcctgaaatgtggcaaccggcaaacacaaatgccttactgatgctcatttatgggttatttggtttggctgttgctgctacagtagttgctgctgtattccaatttggagcagctttgaaagatagccctgcaaatgcaattaagtcattgcttggtttggttcttttggttgttgttttagtgattgcttgggctgcaggtgatggaacaccgatgaatatcccaggttatgacggtactgacaacgttcctttctggctgaaattaactgatatgttcctttattccatctacatcttgttgtttgtaacaatcgttgcaatcatcgcaagtggcataaagaaaaaaatatcataatcaattgaggatactcaatttaataagtaattacaatggcaagaggaaaaagaaaagttcctgatattaactcaagttctacggcggatatcgctttcttgttgctgatcttctttttgattacaacatcaatggatacggaccgtggtttggcaagacttttgcctccaccacccgaagatcaagatcaacagaatacggataagatcaaagaacgtaacattttgcaggtatacctgaataaggatgatgctttgatgtgcggtaatgattatatcggtgttgagcaactaagggaaaaagctaaagaatttattgctaatgccggcaatgcagagcacatgcctgaaaagacacagaagaatgtggagtttttcggtacgactctcgttaacgacaagcatgtaatttctttgcagaatgaccgtggatcttcttatcaggcatatatcagcgtgcagaacgaacttgttgctgcatacaatgaattgagagatgaactggcccttcagaaatggcaaagaccttatgcggaattgaacgacgaacagcaaaaagcaattcgtgaaatctatccgcagagaatttctgaggcagaacctaaaaaatacggagaaaaaaggaagtaagtaatgggaaaatttaataaaactggtaaacgtgaaatgccggcattgaatacttcttcgttgcctgaccttatctttactttgttgttcttctttatgattgtaacaacaatgcgcgaggtaacattaaaggtacagtttacacttccggtaggtactgaactcgaaaaactggagaagaaatcgctggtaacattcatttatgtgggtgaaccgactcaggaatatcgtgcgaaaatgggtactgaaagtcgtattcagctcaacgacagctatgctgaagttggcgaagtacaagacttcattttccaggaacgtgcaagtatgaatgagggtgaccaagctaagatgactgtgtctctgaaagtagaccaaaagactaaaatgggtattatcacagacgtgaagaatgcccttagaaaatcttacgctttgaagattaactattcttctactaaacgtggtgagaaataattagttaatttgatatatagagaagggcgtccaagcaattggacgccctttctttttagcttcttttttagcctctctgtttattattctccggcagaggcagactttatgtctgaacttcgtctgccgtatatgatctaaaatctatctgaagtatgttttttacgattcttttgtatctttattccttgactccgtaaacgattgtatggagtttatgtcttatcccttcataatccttttctgcatccaggttgccgtgtaccatgagatacataggcaggaaatcgtctccttctttatacggcggctggtaatagtctttttcccacagtgtaaatccgtgccgttggtaaaagttgatacggcgtttggccatttcctctaccggacgttctacttccaatacaatggggcgtttcaggaactcacataaatgctctaatgtgcgttttccgtagcctccgttgcgcaatgccggattggtagcgaagtgttctacgtaatagaatccgtcgaaatcccaatatgtaataaagccaatgggcaggtcatcgtcaaaaatgatattattatggaagttgcctatccggtctgtatattcacgaagatgttccagttcgcgatattcttcaggtggaaacgattcgacgagaagctcttccataaatttgtaatgttgtacgtccgatgtggtgatcggttgaaatctgatcatacggtttgggttttaagtttgacaatattgtttttgttgttgtaccggatattactataccaaatgttatatcaaatgtgtatacttttatcgggtgaatatatcagttatatgatactatgagatgttactgcctttagttaaggtacatagaactcaataatccgctggatagcacgctggcataccgggcagaactcaggatattcgtttgttttcatgcgacaattgaatgccggccgataaatacctttggctgagtaaccgccgccttcatatacacctaccggatagttttgatgttgtgctacaggtgtggggacaggcgtattcggtgcaagcatatcttcccatttcgaggcaaaatttactcgtgtactgatgttctgttcccacggctctacatccagcggatacgtgtccgtcattacatcgtcatcataaaaatactcatccgccaagcctccgaagctatgtccgaattcatggaccactacaggcttgaacatcggatgatgagcggtagtcagcgtatatgagttgtaaattcctccgcctccgtacacatccgtattggcaaggataataatatgctcataaggaatgccggccaaagcgttgtggatggccttcacccgacttgtagtcaggtaacggtccgagtaaaaagtatcgaaatgagaatgaacggccgtatgtttccattgattttcgcggggaacactgactccgctgtcaatcgacggactggctacagccactacgttgaacttatttttcatcgactggaacggttcgtgtgaaaacaggctttcgcaggctttctgtgcatcctgatagaataagtccatttccttttccgtgtagccttctgccaggatagcgacatctatgcactctttttcgttaccgctctgaagtatataccggtgtggagtgacgtgtgatgttccccgtttatgaatcaagatatcgtccggacggacaatatgcttaaaactggtcatcacttccttgcggggagagaacagtacgatttctacctctgccggctgtttggggtagggaagcaagaatgtattttcgaaccctttggctgtctccttggcttcatcggtggacagccactcctgaaacagagaagaaaaggaagtcttgtagatacattgtcgcgtggcgagatctcggacgatgatctgcccattgccttcgagtggaagttcggacaaatgatgttcacgacctgcccaggagggaagctgagatagctcgtccagatagatcgcttgctgcttattgtttccggtgaagatataatccacccgtaacgtcttattctgaaaataatctgcaaagttttgcgcataacttcctgccgaaatcaggaaaaaaagaagaatactgcaaatttgtttcatataaatagtatatttatgttttttacaaaggtacaaactattgttgacttattcgatatttgcaaataaaagtaataaatcatagtatttgttgccgaaaaatagctaactttgcatgaaagattcattgattaaaacaatttgattcaaaaatgggacatcatcaattagatgctttagatgagcaaattctgaaattaatagcagggaacgcgcgtattccttttttggaagtagcaagagcgtgtaacgtttccggggcggctatccaccagcgcattcagaagttgactaatctgggaatattgaaaggatcggaatatgtgatcgatcctgagaagataggatatgaaacttgtgcttatattggtatatatctgaaagatccggaatcctttgattcggtaacaagagctttggaagctattccggaagtagtagaatgtcatttcactactggtaaatatgatatgtttatcaagatttacgctaagaacaatcaccatttgctgagtatcatacatgataaattgcaacctctggggttggcgcgtacggagacattgatctctttccatgaagccataaagcggcagatgccgattatggtcgacattgaagacgaagattaatcgtacagaataaaatagcttactgtttcacgtaatctacaaaagcatacgggcagagatgtttctcatccacaggatgagcttctctgcttttttcgtgccattgagccggagatacttccggaaagaaggcgtcggcttcaggagcaacgtcgtttatttccgtcagacaaagttcgtcggcaagaggaagtgcctgtcggtagacgcttgcgccacctattatatagacgtgctcatcttccttgcagctttgcagggcgacttccagcgacgggaagacttccgcaccgggacataccgtatccggacgggtggataatacaacgtttctgcgattgggcagcgcacctttcggcagcgattcgaaggtttttcttcccattatgatggtgtttccggtagtcaatgccttgaagcgtttcaagtcgttgggcaaccagaaaagcagtttattctgaaagccgatcgccattcggcggtctacggcggcaataattgatattttactcatggttttataccgctactattccggcaatatgtggatgcgggtcgtagttcaccagttcgaagtcttcgaactggaagtcatagatactcttcacatccggattaattttcatttgaggcaatgcgcgtggttcgcggctaagctgcaatttgacttgatccaagtggttcagatagatatgggcatcgccaagtgtatggataaattcacccgctttcagtcctgtcacctgcgccatcatttgtagcagcagtgcatacgatgcgatattgaacgggactccgagaaatatatccgcgctgcgctggtaaagttgcaggctcagccggccgtctgccacgtaaaactggaagaaggcatggcagggaggcagattcatattctttaaatcggctacattccaggcgctgacaatgatacgtcgggagtcgggattgtgcttgatcgtctctaccgcttcgctgatctggtcgatgaatccgccgtcgtagtcgggccacgaacgccactgatagccatagatatgacctaaatcaccgttttcgtccgcccattcgttccagatgcgtacaccgtgttcttgcagatatttcgcgttcgtatcaccttgcagaaaccagagtaactcgtagatgattgatttcagatgcagctttttggtggtcagacacgggaaaccctcgtcgaggttgaaacgcatctgatgcccgaacacactgatcgttccggttcctgtacggtcacttttctcagttccttcagttaatacgcgattgagtaaatctaaatattgtttcatagcgaataattttccaataagttggtgcgatacaaaattacaaaaatggcgtgaataaattggcaaaccatccgacgaacttcttccacggtgagcgctttttccagaattctggtgtcagctgcgtacagtgctctatatcgttctgaaacatttcgttcagttcgcctgtaatttccttgttgaagatgaaagcgttcgtctcgtagtcgtatcggaggctgcggctgttcaggtttgcggtgcctaccgtgcagaaaatatcgtcgaccatcatgattttggaatgatggaaaccgccattgtacatatagacggtggctccccttttcatcagtttgtgaagtttgtagagggcggcgtccggagtaaacggaatatcggaggcggaagaaaccataatcgtgacatccacaccccgttcgatggtgcgttgaagcgctttgttgatggaggatgtgggcacaaaatacgggttgacaatgtgcacatttttctgtgccgaatagatcgacatggcataagcatgactgagcatacggctgtttttcttcggtgtgcggtctacgatggcgacgactacattggtggtgtccgactgctccttgtgcttggggaagtatgcttcgccgccaatgttttgtttagtctccttgttccatatggtaagaaatatttcttgcaggtcattgacggcatcgccttctattctcatgtgcatatcacgccatgtaccgattttggggagtccgttgatgtagtagtcggcgatgttcattcctcccgtataggcgacttcaccgtcgatgacggctattttgcggtgatcacggtgtgccgcatgattgatgtagggaaaggtgaacgggtcgaacttgacaatctcgattccctgctctcgtatttttttgagatgtctcttcttgagcggtttattgttcgaccagttgccgaacgcatcgaacatggctcgtacttccacgccttctttcactttttcggccagcaggtcgaacagcgcattggctatagagtcattgcggaaattgaaatattccagatggatgtggtgtttggcgtcgcggatggcgctgaataaatcaatgaatttttctcgtccgcttttcagtaatctgaccttgttattgtcggatataggaatccctgactccgataagaaacgtaatacaagggagtcacttgtcagagctatggagtctctgggatgcgtcatcaaactgtcgatgacatctgcctgagcacggaataaagacagaaacagaaataaaagaaatatacgtagtttcaaaactcttctcgctattttagtttacaaagtaacaaagatacaacatctatgtttggagctatcgggagaggagagcaaatttattatactttaacagaagaaatgaacaagaatctcttgatctgggggattatattcgttcgatacatctgaactgtctgctgtgttccctgccgttgtcacacttgtgccaacggcgtggcactgctgtgccagtgcggtgtcacaactgtgccaagtccttggcacagttgtgtgacaagcattgttatgccattgatactactttccgtccggccatgaacagcaggacgaccgttgcaatgatgattgatttcggatcgagactggttgcgccatggttgatcatgccgataagtacatctttcagcgttccccatacggcttccagtccgcccagcgtgacgaagagcgtggctcctactgtcattacgaatacagtccaaaggcgtgccaaccggttgctgcggtcgggcaagtggtgcatgacgcggcggctgaatccgttgtcggctatttcccgcttgttttctgcgaagaaatctttcagaagtttatcattatctatttccgtcataaccgtttctttttaaatacgttgctaatttttcttttccacgcgacaggtggcttttcaccgtccctgccggtattcccgttattcctgcaatcttgtcgatgcttacatcttccatgtaaaacagcgtgatgcaggttcgttccacttccttcagcgatttgagtgactgataaacatccattgtctgccctatgttcgcttgttcggtgcagttgacggcgtctacttccctggtatccaggtctgccatctctttccggctgcgaatataatcataaaaaatattataagcaatacggtatagccacgtggagaaactcgacaagttacggaaagaggccagattggtatatgctttgatgaaggtatcctgtgccaagtcgtcactcaattcgctgtcaccgcaagtcagatgcaggaagaagcgtctgacaggcgactggtatttttgtaccaactggtcgaaggccctggtgttcttgaacaccacgacctgtgcgactagcgatatatcgttgagttggctcatctattttcttcgttcttctcttcgtcgttcctctccgagatgatgatgtcgttgcttctgacggcggtttctctgttcttggtttcctcgttggcatgttgcttgtagccgatcagccattgtcccagtcccataaacatgacgagcagtccgatagcgccaattccgaattcgccggtgatggcccagaggaatatgaagagtccgatgcctgtaaaggtgtttttgattccttgtgtacgttggtctgtcgatttgtgctcccgtatgaattcttccggaagaggttgaccggctgcgagagcctgttcggcaaggcgatagcgtgctttccggttcttgtagcggaagaagaagactacaaatatgatgaataccggcattccgaatatggcaatgatgctgatgatggctaccagaatacctcctccgactgcatttccgaaattattgaacgggaagtcatcgtcgtcagagctgatggtgaagctcgcttttccgtgagagccgcgcgaggagctactcactttgcccgtatctacacttgtcgtgtcggcgtcttcgtcatcgattccgatcacagtgacggccgtgttgccgacatttaccttggcatccttgcctttccctttcgttacggtcacttttacgtttccggtagagtcgttcacaatagtcgtttgtttctgggcgtttgccagcgagaaaatggtcatcatgaccagtaaagcaattaaaatccgtttcatatattaattcttttatttgtttctttgtctgttagacgtagttcgtatgtcagaaagttgcaaagagacgaaatatttttgatatttgcaggaattaataaatgaaaaatgaatttacccgcttcttttatcgactatacccgtgccttactgggcaatgaagaatatgaaaaactggctgccgccttgcaacaggagcctcccgtcagcattcggatcaataaattgagaatgaaggaggaaggattaagctcgctgacagacagttctgcccgtttttccttcaacaaagttccttgggcatccgatggctactatcttgacgagcgtctgacttttacgttcgacccgttgtttcatgccggttgctactatgttcaggaggcttcgtccatgtttgtggagcaggtgctgcggcagtatgtcgagtctccggtggtgatgctcgatctttgtgcggcgcccggaggaaaatcaacccatgcgcgcagcgtgcttccggaagggagtctgctggtggcgaatgaagtgattcggaaccgttcacaggtgctggcggagaatctgacgaagtgggggcatccggatgtggtggttaccaacaatgatccggctgatttctcggcacttccgtcttttttcgatgtcattctgaccgatgtgccttgttcgggcgagggaatgtttcgtaaagaccccgtagccgtggaggaatggagtccggagaatgtagagatctgctggcagcgtcagcggcggattattgcggatatttggccctgtctgaaaccgggcggcatattaatatatagtacgtgtacctataatagcaaagaagatgaagagaacgtctgctggattcagcaggaattcggtgcggaactcttgccgctggaggtgcaggacgagtggaatataacggggaatttactcgacggagaggatgaatctcagagaagtttgtctgtctgtcattttcttcctcataagacaaaaggcgaaggattctttctggcggcacttcgcaaaccggatgcggaagatgaaccggcaacctattcattctcaaaagcaaagtcgtccaagaaaaaagataagaaaggcggagcggctgcttctcccgtttccaaagaacacatggggatggcactgaactggctgaagcaggaaaatgccgaaagatacaccttgtctgcggaaggcgcgggcatcgtcgcatttctgcaacgatataccgatgaactggctgccatgaaacagtatctgaaagtgatacaggcaggcgttctgactggtgaagtgaaagggaaagatttgattcccactcatgcgctggcgatgagcgctacgctcttgcggcaggatgcttttgatacggaagaggtgagttatgaacaggctatcgcttatttacgaaaagaggctattaccttgccggaaacagcccctcgtggttatatcttgcttacttaccggaatattcctctcggatttgtgaagaatatcggaaatcgtgccaataatctttatccgcaggagtggcgtatccgcagcgggtatttgccggaggagatacgtacgctgtaaagatcattcctgaaagaaacggagagcggatagaatgcttatcttgatagcgcggctaatttatcatccataatttagggaagtattcccgtaggtatttccttataattcagaatgaaaccgacctgtctgcctgttcccggttctgctccttccgttatttcttccagtgtgtaggccggaggcggggcaggtgatgtccgtgtttctccaatgggcggcgtgccccagttcagatgtaagttcttgtccagccggtgaagcaggtacgcgtttccccatacggtgaaatggtgttccgtagccggtgaggcatccaatgagaaagtaagggtcagtgtggctttgttatcttcctcttgcttcagtgcataagttcctttggtgatcagttcgagtcccgatgaaaaagcggttcgttgtccttgtttgaagaaataagcgtcacgggcagcgttgctgacaaggaaaatgtcgtcaacacccggcagtaggttttcgtccccattgggacgcagggaggacgagccgtgtatcagattgagatcttcgtagtagtccaccactttaatgggcagagtgagcgtttcctgtgtggcgttgtctgtcactttcagatacgtgcttccggtgagaatgccggatatgtaaatcattcgtccggcgggaactccgctccagccgctttcgattccggcacttgcgatgcggggatttccgatttccagagagtagtctccgtttccactttcgattccgaggtagcgtcttcctcccatgggcacttcgtatttgctgtcgtaaaaccgcaggggggcatcggcatcgtctttacaggcactccataaaataagaatgcaaaacaagatgggggtgtaagagagggttttagttttcataatagtttagtgtttttttacagtccccaaatgtaatgcattctttttatttattcaagtttcgcaggttacttttgcgttatccaaactatcttaattcccctccctcccgggaggaggggtgcccgtagggcggggtggtaggtgagaaaagcattcattcgtattctattataggtatttttatgtttcacctaccacctccccctacgggtactcctccttcccgaaggaggagaatggagatagaatcgactttttagtcacccccatttgggatactattgtttgtcaataatataaagaacttgcgaaacctcagttatttattcaataatcgggcgaaataaagcgggaatttatagcttgctcttataaattcgtgccattgccttctgatattgattctccagctggaggtaattctgatgactttgataaatgacggatacctcgacaaaatactcgatcatgctgatctgtccgcctgtcagagcctgtttcagcagtgcgaggtcttgttgcgcctgaaaagttttcctgtattcctccatagaggtgtgcagtgttttggcctcccgatagagctgtgccagttcggattccacttgcaggctggcattgtctttctgcaagtcgatgttcagcgcttgcgctttggctattttcaccttgttgcggttctcgaaaagcgggaaggagaatcccactaccactccgttgaaaggcgttccggtttcggtgttccggcggtagccgagttccagtttcggcagccattgcgacttgttgacggcgatctgcttgcgggcaacgaggctttcgttgttgaacgccattaacgtgcggtcggcggagagcacttccgatttcagtatctgatagtcggcagggaaaggcgtcgcgggatacgtgttttcttcgaacactacggggatattgccgtttaacgtgttcagttcctgcaacttattgcgcagtgccgtttcgttcagcgaagtttccgtcttgacattcagcagttccagattgattttattcgtttcgagagcgttcgcatctccggtttggaggcgcttggcgtacattttggcaagttcttctgcgttgcgcagccgttcctccaagatgtgtttttgctggcgcagcatgataatgtccagacacacttctttggcgagcaacaatttctcttggcggaagacgtccgcctgactgtcaaaagcacccgctttcagacgattcagcttgttgcgggtggcatacaggctcggaaagtcgaaactttgcgacaccacaagttcgccgatcgtttcgtttttatctttcgctccccaaaggtgggcgtatgataatgtcgggtccggcaggttattgtccgttttggcttccagcttttgcgaggtgatgagttgggcgtttgcctgcaactccttattgttggcttcgatattcttcaaaacctgttcgatgccgctttgggcctgcacttcgcccgtgagggcgagaagtgcgcagcttaccaaagagcctatgatgatgattcgtttcatactttttttatttgtttctatatacatagtagctatatttaactgataattatgcctgttccgccggtacgccgcatggagaatttgccccagcgctacgctggcggtgcatcatcagataaacaatcggaacgatgaaaccgttcaggaaagtagatgttaaaagtccgcccaaaatcactttggccatcgggctttgaatctcgttgcccggcagatcaccgcccagagccagcggtatcagtgccagcgcagaggagagagccgtcatcaggatcggattcagacggtcgagagagccttgtatcacgctgtcgtacacgttcagtccctccacttgctgcaagtggttgtagtggctgatgagcagcataccgttacgggtcgcgataccgaacagcgaaatgaaaccgataattgccggaatgcttacttcgccggtcgtgatgacaagggcaaaaacgccgccgatcaatgccagaggcaggttcagcaagatcacgccggactccttgacactgcggaattcgtggtaaagcaacaggaaaataatgacaatactcatgaaagatgtcagcgccaatacacggctggcagcctgttcgctttcgaactgtccgccatactcgatgtggtagccttcgggcaactggatagtggcgtctacctgcttctgaatatcatttacaacactgcgcaggtcacggtcggcaacgttggcggagataacgattttccgttttacattttcgcggttgatcgtgtttgggcccatcgaggaaaccacttccgccacgtagttcagaggaactttgcgtccgtcgttggtgtcgaccatgaggttgcggattttctccatttcgtcgcgtgcgtcgtccttcactttgacgatgaggtcgaagctcttgccctgctcgtacacttgcgaaatcacttttcctgccagcgccacattcacgtattcagaaaattccggcagggtgatgccgaatttcgccagcatttcccgtttgggctgtatctttaactgcgggcgttcgatttgttgttccacgttgaggtcggcaattcccggaatgtcgctgatagctcccttgatctggttgcccagcgagaacatcttgttcaggtcgtctccgaagagtttgatggcgatatttgccttcgtaccggacaacatcgcgtcgatacggtggctgatgggctgaccgatttcgatgtttgctccggtgatcgttccgagtctctcgcgcacttcggcgacgagttcgctgcgcgggcggtctttcagttcaaacggtgcctcgatttccgaaacgtttacgccgagcgcgtgttcatccagttcggcacgtcccgttttgcgggctacggtttgtatttcggggattgtcagcagcaattcttcggcacgatgtcccatcttgttgctttcttccagggatatacccggcagcgaactgatattgatggtaaacgagccttcattgaacgaaggaaggaagctgcgcccgagcgtaaagaatacccctaaggcgatcaggaaaaggacgatggtgctgccgagtgtcacccgtttgtgagccagcacccatgtcagcgccttttcgtaaatgcctttcatccagcgggcaaggaaggattctttcagttccttgttcgtcttgttgctgcccagcaggtaagagcagagcaccggagtcagcgtgagggcaacgaccgtggaagcgaacagcgccacgatgaaagcgatacccagcggtaccagcatacgtccttccattccactcaggaagaacagcggcacaaagctgacgacaatgatcagcgttgaattaagaatcggcattcgcacttccttcgaagcgttgaataccacttcgagcgtgctgaggcgttcggcttccgctttcagacggttctcccgcagtcgcttgtatacattttccacgtcgacgatggcatcgtcgaccagcgaaccgatggcaatcgccatacctcccagactcatcgtgttgatcgtcagccccatgtagtgaagcgtgaggatggagacgagtagtgaaagcggcagcgtgacaagggaaatcagcgtagtgcgtacattggccaaaaacaggaaaagtacgatgacgacaaagattcctccttcaaaaagagactttttcacgttgccgatagagctttcgataaagcggctctggcggaaaatatccgtggagactttgacgtccgcaggcaaattcttctgtaagtcttgcagagaggcctccaatttgtccgtcagttccagcgtgctggtggcgggctgtttggtgacggtcatgagtacggccggtttgccacgctccgaggctgtgcccagtttcggggctttgggacctattttcacgtcggcgatgtcttccagcgtcaccggaaagttgttcaccgttttcactaccgctttgccgagttcttccactttgggggtagagagtactccgcgcacgatatattcattgccaaattcgtaaagtacgccgccgttggcgtttaggttcatgtcttgggtgacggccatcacttctcccatcgatacgccgtagtggcgcatccgttcggggtccaactgaatctgatattccttgatgtctcctccgagcactgccacctgtgccacgcctccggtggagagcaggcgcgggcggatcgtccagtcggcaatcgtccgcagatcgagcatggaggtggagtcggcggtcagaccgacgatgagcatttcgcccaagatggacgattgggggccgagagtcggcttgcccacgttgacgggaagtgactcgctgactacggcgagcttttcgctgacgatctgacgggcgaggtatatatctgtgccccagtcgaactctacccagacaacggagaaaccgttggtcgaagaagaacggacacggcgcacgccggtagctccgtttacggctgtttcgacggggaaggtgacgagctgttccacttcctcggctgccataccgttggcttcggtcatgatgaccactgtcggggcgttcaggtcgggaaacacgtctacttccgtgtgcatggcggtgtaagtccccgcgataagcaggaggatggccgcgcagagcacaaccagtcggttgtgcagggagtaatgtatgattttatttagcatgatatttcattgattaagtctggttcctcccggtttacttttgagaagtgccggacaggggataaacttgcgtaactataaatgagttctgtgtgtgccgcaagggaacttggatgcggcgctttgccgctagtgctcatgactgtgggcagggatggcgttgcttgcgcttgccaggcgaacttggtatgcgccttcggtcactacacggtttccgggtttgattccggtcaggatttgtacacttttgccattgtcggcgccgagggtcacttcctgtttcttgtagccttcttcatcgagttgcaggtagacgaagaagatgccttgctcttccgtcagggcggtgcggggcacggaaatcacgttttccagttgggaggaaagcagataaacttcgacgaatgatcccggaatcacttctcctttattgtcaaattcgaaggtgacgggcacgtagaaagaattgtctccggaagtttttccgaaggaaagcagtctgccgctcagttcattcagttcgtagacctcattattataaggtgtccggaaattggcggaactgattgtgcggagatatgggtagtatttttccgatacctcggcacggaggaaaagccggcggttctgcgtcacgctgaccagtggctgaccgatggttacgtagtctccctcattgaccagaatgctttttacgtatccggcaatgggcgcggtgatattctgaccgatggccgagtggtttttggcgagcgcttcgtagctgatacgtgcgttttcgtagttctgctccgcctgtgcgaaatccttgtcggacacaatcttgtttttgacgagcgacttcattcgttcgtattcctttttggatacttcgtaagcgattcgggcacgttgcacggggtcaccgtcggcgatgttgtgcgaagaaatagtcaccagcggagtgccgcgaccgacgctcattccttccgtcaccttgccgcggaaagaaacgactccggccaccgtggctacagccaccgattcgtcgccctgggcagcgagtacctgtccgcttgtcttgatcacttgctggaagggggccggtgtgatggcatttaccttcacaccggcagcgtcagctttcgctttcgggaggatgatttcgtcgctgtgctcgccggcgggttcgctggtggcagctttgccgtgatcgtgtcctccgctgcattcaccttcgtgtgaatggtcggctccttcggcttcgtggtcatgtccttctgcttcgtggtcatgtccttcgtgttcatcatgattgtgtgtgacggtctcgtggtcatgcccttcatgaccagtatttttactattgcaagagcccaggacgaataatcccatgactcctataaagataagtttcttcataaatgttgttttcctactaagttttactgtttttgtacgctacaaagatagagtaacgcagatgcaacttgcttgcatttacgtcattacgcaaaaacagagtagggaggggcccgaagggaggaggtacgaggtattttcgtaccgtgcagggattcacgatagatgtagtaatttttgactcgtctttcctgcggtcgtaataaatgttcgatgatcatatccgtaaacagggtggcgacgaatacgtaattcggtccgctgtccgtgtgcacggagggaatgggagagtggaagcgggtcatgcattcgctgctgcaacatgaatcgcttgcggggtgatgatggtggttggggcattgctgctctaccggttggtcctgcttcatgcagatcatcccgttggggtggtggtgatggggaataacggcggctaccaacatgataatgttgataaagaatagcatcgttactatgaatcgtttcttccctttcatcctttatttatatagagctttctaattttgtaaaacttccaatatctttttactttattatagagctccggttgttgctttattataaaacttcaattattctttttccgactctttacttttctctttttcttgcttctgcaagcgttcgagcaattctgtggcggagacgtaaatcacttttccatcgggcgtcccttgactgaggagttttccgtgacgggcatttctttccagtagccgttgttcggccagttggagcccgcgccgcagtttatcactcaattcttgcatttcattatttgacataactcttgatgcgattaaaaagttcaagttcgtatatccggtcctcaccttgctggcagccttcggctacaatcactcggggagaaacactgttatctgctaatagccaatagtctacacgtggcgcatatattcggaacaggttgtttatgcctgcctgatagcggcggtagattgtatcaatgggcacgttatgcccgccttcgttgacccgttgcaatacacggttgacagcaagttccggagagtttagccaaaaatagatcaggcttactttgtatccggcactctgtgctcttgtgatgagccgtgtgtacgagcgagtcgctaatgtcgtttcgatggagaaactggttcttgtagccaatagttcgtcaatacgtttcaacatcagacgtccggcttcgatagccatgctttccggattgaaaggcgatagtcctttggctatttcgtctgcattgacaaattctttgcacaataatatttcgggcagtacagtataagaagctgttgttttaccagctccgttgcatccgcttataatgtataactgcctcgtttcatccattttaaattatctgtttcagatattatgtgacaaatatacaaatactttttctttcacctaaagcagataatgtctttttattgtttattatttcttttccagttcctgcaacgaatccattttcttcttttcgaggaattcgtagatgccgcaaagatgctccgtcaccttcttattgccgaactcgtagaccttggtcaccagtccgtcaaggaagtcacggtcgtgcgaaacgacgatcagggtgccgtcgaaatccatcagcgcttgcttgaggatatctttggttttcatgtcgaggtggttggtcggctcgtccagaatcaggaggttgaccggttccagcaggagcttgatcattgccagacgggtacgttcgccacccgagagcactttcactttcttcatagactcttccggcccgccgaacatgaaggcgcccagcaagtcgcgtatcttgttgcggatttctccttttgccacgtcgtcaatcgtctggaaaaccgtgaggttttcgtccatcagcgaggcttgattctgcgcgaaatatccgatttgcacgttatgtcccagcgtcagcgtgccgtcatggtcgatttcgttcatgatacatttcaccagcgtcgatttaccttcaccgttcttgcctacgaaagccaccttgtcgccacgttcaattgtcaggttggcgttgcggaacacgacatgatcgccgtacgtctttccgacaccttccatcgtgacgggataactgcccgaacggggcgaaggcgggaatttcagccgcagtgccgaagtatcttcctcgtctacttccagcaattccagcttttccagcatcttgacacggctctgcacctgcaaagtcttcgagtacgtccccttgaagcgttcgatgaaggcttccgtttcggcgatgaacttctgttgctcgtcataagccttctgttgctgttcgcggcgttccttgcgcagttgcaggtattgggagtagtttactttatagtcgtagatgcgccccatcgttacttcaatggtgcgggtggtgatgttgtccacgaatttgcggtcgtggctgatcacgatgaccgctttgccgttattgatcagaaaatcttccagccattggatcgattcgatgtcgaggtggttggtcggttcgtcaagcaggagtacgtccggtttttgcagcagcagtttggcgagctcgatgcgcatgcgccagcctccgctgaagtcgctcgtctgacgttgaaaatcttcgcgtgtgaatccgagtccgagtaatgatttctctacatcctcttcgtaattggttgcgtcgatggagtaaaatttttcgctgagggcggacacttcctcgatcagtgccatgtaactgtcactttcgtaatccgtccgtgtttccagctccttgttcagtgcgtcgatccgtgcttccatctcgtgcagatgcgcgaaagcctgtgccgtttcggcaaacacggttctgccgtcttccgtcatcaaatgctgtgggagataggctactacgcaatccttgggggccgaaaccttgccacgggtaggctgtctgactcctgccagaatcttgagtaaggtactttttcccgctccgttttttcccatcagggcgatgcggtctttttcattaataacgaaagaaatatcactaaatagggtagtgccgctaaactctacggctagtccgtctatcgaaatcatacaattctttataatttgaggcgcaaagatagcgaaatatatcaatcttttttataacttgcgggctgaaaagcattattaactgaaatatgttgactaaaaagtaattttagagaataattttaaaaataatatagaaacgatatggaaggcggacaaacaaatgaattcagacctcttatcttagtggctgaggacgacgacagcaacttcaaactgatcaaagcaatcatcggaaagaaatgtgatatacagtgggccaagaatggcgaagaaatcgtggcactgttcaaggaatacggcaacgaggctaaagcgatcctgatggacatcaaaatgcctgtgatgaacggactggatgctacgaaaatcatccgcggagaaaacaaggaaatccctatcatcatgcagaccgcctacgctttcagctctgacaaggagaatgcgatgaacgcgggagcgagcgaagtgctggtgaaaccgatcacactgtcgattctgcgcaatacgctgacgaagtatttccccgaactggtctggtagaccgatctctttttttgtccggtagactgatcttttttgtttgttaaaccggtccttgctccggcaaacatgatctttatccggtaaaacggtatcgctgagtagaaaaacggtataacaattcgggtgttttttcctgttttgtatttgtgatattaataaatagctgacggggataatatggattcttactatatgaaaatccacattatccccgtcagctgtgtccggacgtttctatgtcaatccggatattactgtatcaatccgggtgtattgtctggaatgcctctgcccgacactttcggcagaaggctgtaaaagtaaaataggcggacctcacggtcggcctatttctgttcgtttccgttaatttgttagagttcagaaacgactctatgtaaagtctctcctttgagagattttaagagcgatttttatcggcttccgcctgcccaccaaacgggttcggagtatacgtagtcaccgttgccgtaagcggctttcacttccggattggcagctgtgtcgctgtttccgtatgggtagcgcagcgggaatttgctggaattgtttgggttggtcagcgtgatgaagttttcgttcagtcccttcatacgacggaaatcattatacgtctccgtagcttcaccggaagcaccccacatggcaaggtacttctgaatcattgtttcctgcaatgggttggctgcatatttcgctttcactacgtcgtcgaaatactttccggcagacgtttccgtgattacttcgctggaattggtgttcaaaccgcttcccaactctttgatggcaatgcttatgctgttttccgcattcagcaagccggctactactgcttctttcagcgcgtcttccgcatcacggttcagacggcacagagcttctgctttcaggaacatcagttcgtgatagctcatcagcagagtcggtgcggttttggcgtaaacgaatgcggagataccgtatttggacgtactctgatccgggctgccgttgggagccggaacgaggctgggatcgttggctgctacctgcgaacgttttttgtcgacgatcggagtgaagaaagcacggttggcacgcggatcattgtaggccaacagcttggttccgaggcttgtactggctccgaatccggcacgagagttgtagaaaccgtagaacgggttgatgttgttagagtcgtagatgtcgaatgcagcctggtcgtcagccgaagtgaacgatttgcttacatagtccagcaccttttcataatcggccgatttgttgcttgagcggttgatcagtctcatggtgtagcgggctttcaggccgtaagcgaatttcagccatttgtccgcatcgccggcataaaggaaatcctgctcggtcacgtctgccaagtcttctttctgaagattggcgatggcgtcgtcgagataactgatgatttgagtatagatttcctgttgcgtatccattttcggggtcatgtagaccggagagcctttttcgtccaccagcgcagcctgactgcacggggcatcgccgaagaaatcggcaatcagtgcgcagttgtaagcggccatcacttcggccattccccgggtgacgtcgttgccgtgatctctgcctccttcgccacattggtcgatgatgatgcgggcgttcttcaatgaagaatagatgccgttccatgagttattgaaggtagacgaggacgacggttcgttttcgcggacttcggcgtagtaaagctggttgtctacacctacttcgtattcgatgtacgaagaggcgtatgtattgatgtcaccgctggcgttggagaaagcggtagaggtgattacatctgccaagataaatcttgaggcaacactggtggtgtggtcgtggtccttgttgattctgtccatcgtgtcctccgagcaagcagagaacaaagacagagcggcaacagccagtacaccggttattttatcatatcttttcataatcttctttcgtttagctaattagaattttacatttacaccaaaaccgtagcttgcagttcccggcagagagaaacgctcgaaggcacctcccatgttgtcgttaccctgagatgcttccgggtcgaatcccttcagctcggaccatacgatgaggttgcgggcaaatacgtttacatctacgtttagccatttgctggcgtataccgggtagcttacagaaagctcacgcagtttgatgaacgatgaatcgtagatataagattcgttgatagaacgcaggcgggtgtaataagcctgtgcgttagtcacttcgatgtcgttggcggcatacgtcgggttgccctgcgcgtctgttccggtttctttcacggtgttgggaacgacgaagttgctcttgcgtttttcgcccgattctttggtgacaccgtagaagttcatttcaccggcagtaccgcagtacatttgtccgccttgtttccagtcgaacacggcagcgatacggaatttgtaaagctcgatattcgtgttgaagcccagacggaagtcgggagaaacccggccgatcacgtcgtcttcgcccacctgcggaagtccgttggcgtctactacgatctgtccggccttgttgcgcttgtacgtgctgccgtatactacggggaatttctcgccgataccggcacgcacctgcggagtgacgaatccgccgagatagatgctttcaacacccggtgcaagttcgtctacgtagttgtcgatcttcgagaagttgaaggcgaagtcgagcttgaagttgcggttgttgaccggcgaaacgcccagtgtaagttcgtgcgagttggtatgaatcttaccgccgttcatgatcatgctgtcgtagccggtagagcctgacaaaggcacttcgaagatctggtcttttacgttctgacgcgagtaggtatagttcaaagtgaacagtccgttgaagaatgtcaggtcggcaccgatttcgtatgacttcgtgttctgcggtttcaggttcgggtcgtacaccttataataagggatatatgccatcgttccgttgatcgggtaggcgatgggcgtgccgttgaagaatccgccgccgtagctcggggtgtagtaatagctttgcatgtagtcgcctgccatacctacttcggcgtacgatgcgcgcagcttaccgaatgtgaggatgttgtttttcagcggttcgagttcggtgaacacaaatccgagcgatacggaaggataagtgaacgaacggttgtcgcgcggcatatttgaaacgacgtcgttacggattgttccgttgaggtataccatgtttttccatgccagagacaggttggcaaagttacctaccgtacgtttcttgttgtacgacttggaactctggtagatagaagcattgttgatgtggttccatcccgggaagttgaagttcatcccttcggagaaggcatattgcgttcttttctctacaagttcgttaccgatcagggcgtcgaatacccagtccttgttgatgtcccagcggtaagaagccgtcagcagcgagttcagctcgttgatgctgtagtggtattcgatggcgtcgccggtgtctgccattgtactgccgtatccgtagatttcgctgtagttggtggtgtaggcgtcgtcaccgagttggtatttcacgtccagtttgtggttgtccgtgccgaatttggttgtgaacttcacgaatgcgtttccgaagaaacgttgcgagcgttcggtgaacagattgttgtccacagcccagtaggcatcgtcgatccatgcctggcggtacgtgttctgctcgtacgggtcgccttcgacgtgcgaggggattcctttcatgttgtagctcaccggagcgttgtagatggtagccgtcacgccggagttggcggtagactgcttttttatcttggaagtcacgaagttaccgttgaagccagtcgaccagttggggctgagctgaacttcggcagacattttggcgttgtatctgtccataccggtagtcgggatgatgccttcctggtggctgttacccagcgagaaagagtagtttcctttgtccagattttgggaaacgttgacgttgttgctccaggtaatgccggtgtcgaagaaatccttcatgttgttgtatgctttcggcgttgcccacgggtcaagaccggcttcggcacgttggggcacgtagtattgtccctgacgttttcccattttctgggtgaaagcgttgtcggtgttgccgccgtatgtaggatcgttggcgaggtcggctattttcggtccccagctgtgaccggaataagggtcgtatgagccgccgctgccttgtccgaattcgttttgcagttcgggcagtgtagacacgacatcgaacgaaagattgctgcggaatgtgatcgtcggtttgcctttggctactcctttaccgcttttggtggtgatgacgatgacaccgtttgacgcacgcataccgtagagggcagaagctgcctgacctttgaggatgttgatgctttcgatgtcgttggggtcgatgtccaccgaacggttggcgtagtcggtaccgtaggcagcgccgttagcgttgtcggtagtcgttacgtcggcagcggaagagatcggcatgccgtcgatgacatacagaggtgtattgtcgcccgtgaacgaacgggaaccgcggatcgtgatcttggaagatgcacccggcataccggaagacggagcgatgtccacacccgaaacttttccttgtagtgctcctgcaaggtcggtgttggccgcgcgtgtcagctggtctgacttcacgtcctgaacggcgtatcccagcgctttcttttcgcgggagatacccatggccgttactacgacttcgtctagtgacttggcgtcactttttaatactactttgataacgccttgtgtgatcgtaacagtttgcggagtcattcctacataggaaacgcgcaaagttttagaagaacttggtacggtggggagttgccctttcgggaagcgttaagtgtttttggggctatttaaggcataaaatgataaaaagataccatttcgaacgaatatctgatgttttttttatgaaaatagcggttttaacactttctttctgttaggtaataatgtttaaatgctgctaaatacgtctttagatttacttatttgatttattctctgattaaattctttcaatatgatactttatagttaaaaacgtaacacttttttaattttgatataaatagtgttatctttgcaccctgttagagactagaagtctatttataggttaaatttaagagagaatttatgaaaagaaaattgatgttctttatgaccttcctttttgtgggtataggtctggtgacagcgcagacgtcccgagttaccggtgtggtaaccgccgaggaagatggcctgcctgttgtaggtgcttcggtattggtgaatggcactactcttggtactatcacggatattgatggtaagtttacaatcacgaatgtaccaagttcttctaagacttattgatattttatagcctctctttttcctcctttttcgtcctatcttattgtaaatcagaatataagtgctgctttctgcaacttggcttcccggctcacttactataatcgcaaccttttccctttctttttcgatctcagtcatctttttcgggcaggtactcggcttgttttcaggggggcggatgcttaggttctacctttatttgaggctttctatgagcgataggggcagaccggtcttttcggcaatgagttgattgtcaattccttgctttttcatgtcgatggctgtctgaaagatgttcaaggcttcttcgcgacctttcttcaggccttcctcaagtccttcttcaagtcctttcttcagtccttctttcatccctttttttattccttccttttccgctgcatccattgtcaccaaataatcccggtacactttgacgctattatcgtatagctccctctcttttggggacatagaagccacatcagcgatctcttcgagtttttcgaagacggcttttcgtgccttgaatggcaggcgttttaaagtttccatattatttaatatataaatccaacgttcaaaattcgtttcacattcctcttcgctttttttgaagagggggagggcgatgaatatttgccggaatttctccgagaagagttcaccagtctccttgtctgcaagaataacgtctgtccggagttttatgttcttgtccatgatgaaattcatcagaaagactccgtaaacagcttttatttcaaatttccagtcgtgccccgtccggccctggttgacgatggcacgggagagatagaaaatggagcgttctttaaagttgctctgcatgcggttttgcatttcgacaattatcttttcgcccgtgtccgtggtgcagtagacatcgtagatgatgcctcgtccttccgggtagtccggcagctgctcgttgttcaaaaacgttaagtcggttatcactcgttcaccttcgagaaggtcgttcagaaattcgattagtaaatccttggagacttctctgccgaatattaatttgaatccgtagtcggtgaacggattgataaatttgctcattgttttggttgttgctcttttaggttgtaaagagaggtttctctttgcatacggtaaagaggctttttctttgtcccacaaagataggataaattattgttttatgatgcgtttggcgggagaaataaatgacgtgggcgctcaaaaatgctcatcttcctcttaaaaatgttcatcttcccctaactcgctttttgaggataccggtgtaggtgtcctcaaattctgccgggtgattgagcgcccagaggatgtagtcgcccggctcgttctttttgagcagggtggagcggtattcggagctgaggactttccataaggtgccgcacggaccacccagctttctgcgtcgggcgagggcgaggatgcctttcacggtttgttcgttccggatgccgatggcgtccatgttgaggcgcagcagggattcggagaatcctccggaagcaatgctttcgttcggggcttcttcctgctggtttctttcgtactgggttccgttgtgcttgggttcttcctgctggtttctttcgtactgggttccgttgtgcttgggttcttcctgctggtttctttcgtactgggttccgttgtgcttgggttcttcctgctggtttctttcgtactgggttccgttgtgcttgggttcttcctgctggtttctttcgtactgggttccgttatgcttgggttcttctagctggtttctttcgtattgggttccgttatatctagcttctcccttctgatctattcctccatttcttctttcttccttattttcctcctccctttttccggacgagatttctaaagacaaacctttgacagcaacaggcgcagcctgagaaacgccgtttgacggaacgggcggctgctctctatctttctcccattcattttcggttttgctttgtctttctctctctttgtctttttctctttccggtttgatatcattttccatctctcttttcggtttgctttgaatctcagtatccgtttccgatttactttcgatttctgtatccgtttcctgttttgtttgtgggattgttgctgcaatttctcggttttttgcagcattaattttcatagctgctccgtcggtcactgtttttgtagcattgattcctgtgcctgctgcatggatgtctgtgcctgctgcatggatgtttgtgcctgtcgtgccgattcctggctttgttttagtaacttctgtagctgtgatattgactcctgtttttgttgtgttgactcctgcatctactatcttgttttccgcttcatccacttctgtaccttttgaatttatattgcttcttatgtctgcggaattatttcccgttccatccttttcttccttgatgagccaaaaccgttccagcggaagtttgtatttccttcggctgtcggtaatgattttgtggtattgctcttggatggcttgcgaagtcagaatcccgtactccttatatatataggtgtcgaacagtccgacggacaggcagtcgtcgatgatggcctgcatctcctcctcctcgcaacacacttcctgcgaaatgtcgaacaaggtatcttgattccatgcgacgtaaaatcccttttctttgtagatgaggcagagcagggaagtgagtgcggcaattcctgccgcatgatgacggttggaaatgcggcgtaccttcctgtcttggaagaagttgacatcgagcgggaaataatctaatccgggtttggaaatacgggccatctttttgaatatttagagtgatattgactgataaataatgaataaggcgaatcggtaattttaatttagctcatttcagtatggtgataagctacttgatagtcagttctgtatctcaactgagggtgactaaaaagtcgattctatctctattctcctccttcgggaaggaggagtggtcgcagaccgaggtggtaggagaaataatgtttatacctatttttttgtaaatgataggattatgcattcacctaccacctccccctacgggtactcctccttcccgaaggaggagaatagagttactattgcgtacaactactccctagaactcctttttcacatcgaagcagggacaggctttcatgtattcattgggtgagatgatgccgtctccgttgaggtcggggcttgtgtcccggtgtccgatgacctgtttcacgttggggaaggccagttgcagagatttcaccagtcggatgagggcggtgcgttgtgcatctgtccgtgtgtcggcggggcggccttccttgtccagtccgccgacgtagcagatgccgatggaacgctggttccagcccatacaatgcgccccgtcgagggtgacgtcccgtcccggttcgatggtgccgtcgaggcggatgacgtaatgatagccgatggaccagaagccacgggcacggtgccagcagtcgatgtcggcagcggtgatgtcctgtcccgcacgggtggcggaacagtggatgatgatggtgtctttcattgcagaaactcctttctttgtcctctttctctgggcaatatataagtgttgaaaccaaaaatggcggattcttcgggggacaggcggcggtaatagtgctgcgtcactgaatgatgtataggggcaaagagagaaataagaggaaaaggcgatgaaacaaaggaaaaagaaactggctgcacacatacattgcctgccttgaactccccgactgaattgctcgatttgcctatcccaagcggattacctgcttcgaactcctcgactgaattactcgatttgcctatcccaagcggattgcctgcttcgaactccccgactgaattgctcgatttgcctatcccaagtggattgcctgcttcgaactccccgattgaatcagctttgacggtcagcacaggtatttcgggtgctatcagaaagcattcttccgaaccgcttctttcggctcttgactttttcttcatggccgattgcttcagtctttcggggtgtaataaatgcagcaccagccaattacgttgtttagggttcatttgttccccttttaccagtgcgttcatggatggataggcttgcaggatatttcctgcctcgtccgttgtggcacaggggacgggggagagggcgggtgacgacggacgcagaccggtccggatggcgtgcatgacattgtcgtaggcatcgcaccattcgaggttggcgacgtggttgttgagcttgtttccgtcgaggtggttcacttgggggagacgcttcgggttggggataaaagctgttgccactaagcggtgtacagagtagccgacgtatatccccttttggcggatggccacgtactcataaccttttgcggtaatgctgctgctgattatcaacttcgatttgcctttgaaactcaatatccgcccgtggtctgaaaccatataatcggaatttgcttcgataaatctccaattttccatactttattctttatattgttaataaaattatacttcgttaaaaagaaatcccttttccgaaaccaccggggataaacggcgcagcctgcatggtagaaacggtgtagcctgcaaggtaaaaacggcataaacaaggactgttaaacggcgtagcctcctcgctgacatgaggcggttccgcccgcttactccggtctttgacctttctcattcctcctctgcacggggttcgagccgttcggcacagcgaacgagaaactccagttcctcccgacacccttgaatggcttcgtacaaagagtccacatgatacattctgcaaagcgtttcccattcttttcgttcttctgaagtcatttgttctccgaaattcatttgctgtccaaaacttatctgctgtccgaaactcatttcaaaatttatctgctgcccgaaactcatttgctctccgaatctcatctgctcttcgaaactcattcgacgcaaaggaaattttcggcatgaaacgtgcgccaccctttggcttcgaggtcgtagtagactacaaacgtattttccggtcgtggcatataggggcggtgaaaactgtgttgatatccggtgagcgtgccgacagcgtggcgcacggttccgtcctgcttggtgtagcagaatttcacgttctccctgtgcatcttccttatcagtccaccgattcggtgggcgatgatgagcgcatcacgccggttcatgtcattgttgcgacggatgacggcggcccgcctcatgagccgtacccgtgggagggaatgttgttttttcatttcagtcatatgattcaattgttttttattgatttcggggcaaaagtagactgtgggtagaataaaaaccgttcacgcttgactaaaatgaaaaaatatgtagaaagagtcacgcgtgacccaaaatgttaaaggtaaatcccgaattttgtcggattaatttaaatataattagtaatgaacaaaaaagaaaactgccagaacagtagtgaaagagaacaacacattgaagtaaaaaggactgtaaatcagaaaagtacaagtcagaaaaaagtaaatcagaaaagtacaagtcagaaaaaagtaaatcagaaaagcatgagtcaggaaaaagcaaatcagaaaagcatgagtcagaaaaaagcaaatcagagtggcgaaaagtccgtgtatgacgagaacagggatgcccttcaggaaagagtcgaagagaagcaatggaagaaaaagcaatgtaatggcttgcagcacagtgatgacgaagaaaaacagaaagtcatcgattcgattatgaaagtcagccgggataacggctttgacgacgcttatcttcagcagcattcggactgttcggcatcgtcgatcaagcgcttccactcggcctggatgggaaagagaatgtccaattggacgacgatttttaatttagcgcactgcgtgtccgtcaattgtgtctttgccgaaaatctggtcgggatgctggttgtcattattatgttcttgattagagatgccggaattgtgagttaccatatcgactcgcccaagaaagtggtgatagaaataaatttcggtaaagataaattattgcgcatgaaagacgaggaaaagaacgaaaaaggaaaagaaggtaaagacgacgaacacctttgagcgacgacaatgatcgggacaaaggaaagaacaactgacggaatgaggtaagtcctgtaagaacttggtagtctgtattcgtaaaaaaacgattcgatatcagcgatggatttccattttattcccttgttataatgtcaccacaaatgtaatcatattattgagaaaaccatgcagaaacgcttttattctgaaaaataagttttattgttcactcagatttcatattcgatgttgacatcctacgttttctcttttagatatttatttgttttcctttgtcggtttctaccgtattgcacgttcgtcattatttacaaattctaattattgcattctcagttcgggtaaaacgaatccgttttccgagctgagaatgcagatgacggcttttaataagtctgtttgtttttatttctttagtaatatattataaactggcagataagtcgctctaccaagttcttacagaacttacctttttgtatagtaatatttaaagatttaatagcaatattttaagatattcagtgatcggttccgcaaacaatcaaaacaatcactatttatggaagcgcggataactcgaaaaacagcggcacttgcaatctttctgatcagtgcatttcagacttacatttatgccggccgcccctcttcttgtcaactattaatcatcaattcctataccgaaaactgtctgtggagcgatgactttatggcccctgtctataaagagtttcgcgtccagaacagcccggttgacatatgtgccgagcacatggaactgatggcgaccgttgtcccggatatgcgcaaacaggtcttcatgtccgacaggcgctggatcagtgcgcaatgcaggaaagaagcggaggaagtgatgcctttcctgttgatcggcggctatttctggacagacagtgaaataaagaaacatctgctcccggtgatcaaaagccgcctggacggagcgtcgcatccgcacagagtggaaacgacagcgatggggacgcccccatccgtcatcaattatgccgactacgtagagagcggactgttgctcggcctgtgtcccgacgacactgtttttggtatgaagccccccacttttttcgagcggaacaaatattatctggccctgtttttctctttgatggcactggccgtcatctatgtgatatggctccggagggcgctgcatgagaggagcaggcggctggagatcatgaggagctatagcagtctggtcgaaaacatgcccgttctctatgcccgtgtcgagctcatattcgaccccggtgcccggattatcgactatgtctaccgggaagtgaatcccactttcgagaaatacatcctgcccaaagaaaaaatactgggaaagaaatacagcgaactcaatccggattattcgccggaactgcccgacaggtacagcgaactgaatgacaacaggcaaataacctttcagtattatctggagaagacgaaaactcatctgaccgtcatctccatacattccaaaacgaaaggctgcgtcgatgtctttggtgtggacaataccgaactggtgctgacgcagcaaatgctgaaatccaccaaccataagttgtccgccgccctcgacgctgccgacatgaccccttggaaatgggatttgcagaccggcctcctctcgtgcaacgtcagccacgacttgtacgtcaccgaagaggaggtgacgcatgacggcaacctgattatcgtgcccacctccgcctgtttcgcgaaaatctgcgatgaagaccgcgaacgcgtgcgggacgccttcgagcgcctcgccaatggcgaaacgcagaaaatgcgcgaggaatatcgggtaggcagacagtggcttccctccccgcaacagaatgaatgggtagaagtgcgcgcagccgtggacgagcgcgacgcgaacggaaaaccgctgagccttatcggcacttcgatgactgtcacccaacgaaaggaaatggaggaagcgctcgtacaggcaaaggtgaaagccgaggaggcgaacacgctcaaatcttctttcctcgccaacatcagccacgaaatacgcactcccctcaacgccattgtcggcttttcctcgctgctggtgtcggcggaaagggggatttcggaagagaaacaggaatatatcaacatcattgaaaacaacaacacactcctgttgcagcttatcagcgatgtgctcgacctttcgaagatcgaagccggaacgatggagttcgactacgccccggtagatgtgcacggcctgtttatcgaactcgaagatacgttccggttgaggaataaaaagtccggcatctgtatctgctatcaccgccggacgaccgaatgtgtcgtaaaggcggaccgtaaccgtctggtacaggtgatgatgaatctgatgaataatgccgtgaagtttaccggggaaggcagcattgagttcgggtttgatgtgcgcgaagacggtttcctgcatttctatgtcaccgacaccggttgcgggataccggaggaacggttggaagaaatcttcgggaattttgtcaaactcaacagctttgtgcagggcacgggactcggactcaccatttgccgggcaatcgtcgaaaggatgggaggaaagatcggtgctgtctcacggctgggtcaggggagtactttttggttcacgctgccttatacggccaacgaagagaaggtttgaaagggacgtggcgtgacggaaatatacttgcttcccgaagaatgggactttttagtcagccccttcccgaagggaggggaagccatgcggatagtcagctcgaatcaaggctcccccaagaaacggaagatgagccctacttgcgccggagtgagcaggatggctttctcggaatatcccgtgcgggcgagttcgttttgtagtgccgtgttcttggcgatccagctgcggagagtgcggcgtgcggaggcgggctgtatgtggggcaggtagagagtggccagttggcttttgctgtatgcctgtatgcggggcagggttgcattttcttcggaagttggtttcatgatttttgctttcattgtcttttgatactgcttttactatcttttctatatttctttctttcattttcgttgccaatgtaaaggtacgctttttttagtcgtttggtgttgctttgtacagaagtccttggaggcagtatttgtgcgaggccgtgccgactggtgctcttccgttacaagtcgttacatcgtgtatccggacttttttgccatcgcctacttttgtcaccgtaatcgattgcacatagaaaacttacatcaaccattaaaaaaagaaaggaaaacaaccttatgccattaatttacaaaccttaccaggcgaatatcgccaacaaagcgggacagaaactgtattacccccgcctcgtgaaattctcgaaaatggtcaacacgcagaagatggcggagctgatcgccgagaaggcttctctgacgccgggtgatgtccacaacgtgattcgaaacttgatgtccgtgatgcgtgaacagttgctcaacagccgcacagtacgtctcgaaggcttgggcacatttacgatgatcgccaaagccggaggaaagggagtcgtgttggaaagtaaagtcagcagttcgcagatcgtttcgctgcgctgtcagtttactcccgaatatacccgttctgccgatggcgtcactacccgtgcactgacttccggagtagaatttgtccacgtcaaggacgtagcgggcggctttgtggacgacgatgataaaaatcattcgggaggcggagacaaccccggcggaggaagcactcccggaggcgacgacgatgaggctccggacccaaccgtttaatgaggctgaatcgctgactcactaatgcatgatcggttcccttattaaattgctccattcactctgttttttaactctaaagaaggaagctatgaaattatttttagaaaagttattggatattttggaagcactcttgcgcttccgtcgtcggaaagctaaaaagacgggagattcataaaccgacctcctctcttaaaaactagagaatccccttttatttaaaaccgtatctgtctatgatatggggttgaataaaggggatttttgtatgggaaagtaataggtaattgtatagtaataggtagtggaatttaattcatttcatttcttgtgcgaaatgattcatacctgctctgagatgtaggatttatggaaaagtgtattatcaaaaaatggggtcacctatacccctgtttgctacattatgttttttgagcccgataatgcggtagttggagaattttgacatctataaaagaatatcccggcagattggataacagtcaaccgcccaaccataaaaagggctgccccaattctacttgggagcagcccttcttgctttttccggtttatctctaatgcattttatttaatcagatagactttttgaagataaacccttttgttgtgtgcttttgggggatgagccaccttacggcatttctgtttccatttggaatttccggcttaccttcatcaggttaatgatgtaagtcactacattttgagcttcctgcaccatggtcagataaaccatacttacccggatactgcccgactggctttggatgcgctgcaactctttgcgtttcagttgcgatagctgtccgttgaggtcgttggcacggcggatttcctcttccatattctgataatcgttgttttccaacttcttgcggcattgctgaatcagataagtgatgtcctcggccacgtcgctgaattcacctttctgaatggcgtcgagcgggttgaagttattgtcgatgtgttcaagacacggttcgcagaggcgcgagatgctgtacaccagttcgctggcgaagtcgttgccttgatagtagtagagtcctttttcgagcacggtgttgttgtcgaggcggcacatggcaacggttccggtgcgtttcatctgcttgatgagctgcttttcgaatttcgtggaacccatggcacgacgtagtccgcggaggttttcgtgtataaaggaggtgatggtcagttcgaaattcgtttcggcgtactccagcactttggcgagttcttcgcgggtatgtttacgcatcagttgcagcgcttcttcgctgtcggcggtctgcatgagttgtttcagcgtttcgttgcctttctctttcgccttgcgtttcttatacatcacctggctgcggatgaggatgaaaatcgctattccgatcagtgcgatgatggagatgttgccgccgtagtgcagcacgagggctacgaagaagcagatggtgaaggcggctccggcagtgatgaaccagccaccgatgacgctcagaacgcctgtgatgcggtagacggcggagtcacgtccccatgcacggtcggcgagcgacgtacccattgctaccatgaaggtgacgtaggtggtagagagcggcagtttcagcgacgttcccaaggcgatgagcagaccggcgaggacgaggttgacagaggcgcggacgaggtcgaaagcggctccgtcggctatgatggcttcgtttttgcggaaacgggagttgatccactgcttcgtgctttcgggcatgatgcgggaggtgccgttggcaagtgtcatgctgaaacgtaccagtgtgcgtgccatcggggtacttccgaagttctcttctccttcatcctgacgggagaggtctaccgaggttttgatgacggcgtgcgcctttttggaggtgcagagggcgtagaccatgatggcgccggcaccgataaggaagtaccacggtgtcttggcggggcctagcagcgaggtcatcaggaagctgtccggacttgctccggctccgttggtggtgtagtctatgaaggaggagtagcctgcgagggggactccgatgaagttgacgaggtcgttgccggcgaaggcgagggcgagggcaaaggtgcccatcagtaccactactttgaaaacattgactttgagccagtgaagcacttgcatcagtgccgtgaagaagacgaagaagctggcgatgagcagcagcgtgttgtcctgtatccactgtttgttttcgggggtcatgaaggagctgtctttcaaccctttgatcagcatgaagtagatgatggaggtggcggcgatcccaccgaaaaggccgatgctgtatttgatgtttttcgtgtaattgaacgtgaaaacgatgcgggcgagccactgtactaacataccgaagaagaaggcgatggctacggacacgaaaatggccatgatcacggaaagtgctttgtcggtgttgatcagatcgcccaacgcaagggtggcgtcattgtttactttgatcagggagagggcgaaagttcctccgagcagctcgaagaccagtgagacggtcgtggaggtgggcatgcccatagagttgaagacgtccagaaggactacgtcggtcagcatgacggcgagcagtatacacatgatttcggcaaagtagaaatgctcgggctgatagattccgtgacgggctatatccatcatgccattggacagggatgcgccaatgaaaataccgatcccggctatgaaaagaatggttttgaacgaagcggccttggcgcctaccgccgaattcagaaagttgactgcatcattactgactccgacgatgagatcgaacacggccagcacgaacaggaaaatgataatgcataagtaaattgtctccataaagaaagttgtgtatgtttatttatggaggcaaagaacggagtttaacgttgcggaaaaatgtcatacgtgttacatttctgttacaatgtcttttttgagccattcataaaaatcgtattgggcacggacagcaggggtgccggacgctctttttttgaatacgttttgcagtttgtcgtctacccaacaggctttttggttgtcagcgagctggatatggagcatttcgatcagactggcgcgcaggtcggggtcgaggatgggggtgacggcttcgatacggcggtagaggttgcggcgcatccagtcgggcgagcccatgtatactttggggtggccttcgttgccgaaataccagatgcgggcgtgctccagaaaactgtcgacaatgcgggtgacacggatgttacggctgtatgactgctccggtatgaggcagcagatgccgcggacgatgaggtcgatctgcacgccgtgttcggaggcctcgtagagtcggtcgatcattgcggggtcttggagggcgttcattttgaggatgatacgtccgcctttgccttggtcggcaagggatatttcacggtcgatgaggcggttcagttccggtatgaggttgaagcgggcgacgaggagagtggtgaatttcggatcttccttgccttgcagggtgcggaagaggttgtaaaggtcgttcactatttccttgcggcaggtgaaaagtccacagtcggcgtatagggtggcggtcttttcgttgaagttgcccgtgctgatgtaggcgtagctggggattttctctccattcagtccgcggcgacggacgagggccactttggcgtgtacttttagtccggggatgctgtaaatgattttgatgccggcggcttgcatcatttcggcggtggcgaggttgttctcttcgtcgaaacgggctttgagctcgacaaatacggtgactttcttgccgttctgcgcggcggctatcaaggtgttgatgacggccgagttttcggctacacggtattgggtgaccatgatttcgcgcgtctccggattgtgcactgcttcgtagaggaagtgggtgaagtgctcgaaggagtggtacgggtaatacagcagcagatccttttgggcgacgtagttgaagatcgattctttttcgtcgaggatgttcagcttcatcggttgcggcttttcgatgcggcgtagagacttgttcgggttgggcaggtggcgcaggtcttcgaggttcaggtgcttgtcgccggggacaagttcgtcacggtggatgcggaaggcgtcgaccagaaagtcgaggaagtcttgcggcatggcacggtcgtagacaaagcggcagacgtcgcctatcttgcgtttttttaccttctttttcagttgggctacgaggtcggcgctgctggcggtgtcatctatcagaatgtcggcgtcacgggatattttgatgcagtagctcgaatcgacgtcgtagccggggaaaataaggttgaggttcgctttgatgatgtcctcggtgaacatgatgtaatagttgtctccacggggcggaagttcgatgaaacggggcactttggcgtacggctgcttcatgacgaaatagaaaggctgccggttggcggggttcctgttttccttcggatagaggcggatggcgaggtagagccggttgtctcgtagaaaagagactattttatctttcgatacgggcacgggttgcaggtaggggaagatttcttcccggaaaaagtccttgataaactgctggtgaaacggttccacgtgtctgtcctgatagaagatgatgtggtttttgcgcagggcgggcagtatcttttcttcgtaaatgcgtacacggtcgtccagctggcggtttacttcgtggttgatttcttccacgagttcgcgggcggattgtacggtttcttcatcgctctccgttgcgccggatgccacggccttgtggtccgccacccggattttgtaaaactcttccagattggaggagtagatggagatgaaattgatgcgctcgtatagcggcaggtgctcatccagcgcttcgagcaacacccgatagttgaatgagagccagctgatatcacgtttgaaataattatatttgctttccatgtgctttaagattttcccaaatatagtatctttgcaggactaaacaaagaaaattatgacaagaattggattattgtccgatacccacgcttattgggacgaaaaatatctcgaatattttgaatcgtgcgacgaaatctggcatgccggagatatcggttcggtagaagtagccgagaagttggcggctttccggcccctgcgggcagtttacggcaacatagacgggcaagaaatacggaagatgttcccgcaggtgaaccgcttcacggtggacggagcggaagtgctgatcaagcatatcggcgggtatccgggcaagtacgacccttcggttatcggcagtttgatggcacgtccgccgaaacttttcatcagcggacactcccatatattaaaggtgaaatacgacaaaacgttggacatgctgcacatcaatcccggagccgcagggatgtccggtttccataaagtgcggacaatggtgcgctttgtcatcgacaacggaacgttcaaagacctcgaagttattgaactggcaggatagatttcttacaattcattttgtcacgtcagatttctttccgacctttgcacacagtaaaatgaataactcagacgacaatgaaaggaattattctggccggtggaagcgccactcgtctttatccgctttccaaagcgatttccaaacaaatcatgcctgtatacgacaagccgatgatctattatccgctgtctacgcttatgctggcagggatacgggaggtcttggtcatctctactccgcgtgatttgccgatgtttcgggacttgttgggctcaggtgaggagctcgggatgtctttctcttacaaaatacaggagcagcctaacggactggcacaagcctttgtgttgggagctgatttcttgaacggtgaggcaggttgtctgattcttggggacaatatgttttatggacaagggttttccgctatgctccggcgtgctgccggtgtggagaagggagcctgcatcttcggctattacgtgaaagatcctcgggcttacggggtagtggagttcgacgaacaaggcaaagtgatttctctggaagaaaagccactggtgccgaaaagtaattatgccgttcccggactttatttctacgacgctaccgtgacggaaaaagcggcttctctccgcccttcggcacgtggagaatatgagataacggacctgaaccgcctgtacctcgaagaaggaacactgaacgtggaactgttcggtcgcggattcgcgtggctggataccggaaactgcgacagcctgctcgaagcctccaacttcgtggctaccattcagaaccggcaaggtttctacgtcagctgtatcgaagagatagcctggcggcaaggatggatttcgtccggacaattgctgctgctcggacagaaactcgaaaagaccgaatacggtaaatacctgatagaactgtctaaacaacccttgaaataaacataaataatcatatatgaaaacttatctggtgaccggtgccgcaggatttattggcgccaattatattaagtatatcttggccaagcacagcgatataaaagtggtggttcttgacgccctgacgtatgcgggtaatctgggaactattgccaaagatatcgataacgaacgttgtttctttatcaaaggagacatttgcagccgcgaagtggtggacagcctttttgccgaataccgtttcgactatgtcgtgaacttcgccgccgaaagccatgtagaccgcagtatcgaaaacccgcaactgtttctgatcaccaacatcctcggtacgcagaatctgctggattgtgcccgccgtgcctgggtgatgggtaaggacgaacagggatatcctacctggagaaaaggagtgcgctaccatcaggtatctaccgacgaggtgtacggctcactcggtgcggaaggctacttcacggaagaaaccccgctttgtccgcacagcccgtacagcgcttcgaaaaccagtgccgacatggtagtcatggcttatcacgacacttataaaatgccggtaacgatcacccgctgttccaacaactacggcccctatcattttcccgaaaaactgattccgctgattatcaagaatatactcgaaggcaaacatctgcctgtctacggtgacggaagtaacgtgcgcgactggctttacgtagaagaccactgcaaagcgatcgacttggtagtgcgcgaaggcaaagagggcgaggtgtacaacgtaggtggtcacaacgaagaaaccaatcttgaaattgtgaagctgaccattgccactatccgtaaactaatgaccgagaaaccggaatatcgtcaggtccttaaaaagaaagtgaaaggtgaagacggagaaatctccgttgactggatcaacaacgatctgatcacttttgtcaaagaccgtctggggcacgaccagcgttatgccattgatcccacgaagatcacgaacgccttgggctggtatcccgaaacgaaatttgaagatggcatcgtgaagacaatcgtatggtatcttgaaaatcaagactgggtggaagaggtgaccagcggagactatcaaggttattacgaaaagatgtacggaaaataaatcaatgtcggatcaagaatcctattgatagcaaaatacccattaacagcatattacgtgaagtctcacctagtatgctgtttaattttttaccactgtgaatctgcaccatccgtctccatgtgaggacatgaggaatcaggtagagtaacggaagaagtgcggcaaacaagtgtccttcgaagaagaaccagaaacacagaagacttgctgccacccccagcatcaaataaagatagcgtccgaacttctcgccaaaacgaacgatgaccgtccgctttccgctccgtgcatccgcttcacggtctcggtaattgttgactaccagcaaggtatcaatcagcagtccgcagatcagagaagctaccgttgtgtccgaagtccatgtcagcgcctgcacgtagtacgttccgcccacggggacgaatccgaaaaatacgatgaccagaacatcgccccagccgttgtaggataatggataagggcctgtggtatagaggaaagcgaagagtacgcagagaagtcctactatgatcagctcccatccggcataaaacagcagcgcagatccgatcagacaggcgaacaggacggtgacgatgattccgtttcgcatggctctcggtgaaatccagccttgtgcgcaggctcgttccggtcccagccggtcttcgcggtcggttcctttgaggtagtcgaagaggtcgttgataaaattggcggcaatttgcatcagaccggcgaacaggcagcagataagggccggcaaccattgaaaatgtccatccatataagcaagtgcgctaccgatcatgaccggcgtaatggctcctgtcagagttttgggacgtgctgctaatatccacgcacgcagcgagttacgctttacttcttccatgctttaatatataataataagttttgacggacaaagatacatgatttttcctatctttgcgcctcaaatagtgggggaatgtgttatatgtagaagaaaataaaccaaagaagatgaaaaaaataaattacctgttcataatattcgtattattcctgttcgtatcttgtaagtcaaagaagaatgttgtatcgatcctgcctcgtcctgtgctcaatgtcgattccgtccgtccggacagttccgccgctatcgacggcttgtttgctccggatcattctcagcttgccgacttgaaagtttcgacgaaaaagcagaagaaaacagcgaagaaagaagctgcgaccgagcaggaagaacgtaatttggtacttcgcggaacgaagatcacgtcttctaccgtgaacgtccctgccacttatagcggcatagaccgtgtcgtggaatatgacttcacccaccgtgatgtccccgaagccttcgaaggcttccgcatcgccttcatttccgacttgcattacaagagtctgctgaaagagaaaggcttgaacaaccttgtcgatcttttgatcgcccagaaaccggacgtcttgctgatgggaggagactatcaggaaggctgtgaatacgtagaaccgttatttgccgcattggcccgtgtgaaaacaccgatgggaactttcggagtaatgggaaataatgactatgaacgctgccatgacgaaataatccgcacgatgaagcattacgggatgcgtccgctggaacacgaagtcgatacattacgcaaagacggtcagcagattatccttgccggagtacgcaatcctttcgacttgaaacaaaatggggtgtcgcccacactggcgctttctcccaacgacttcgttatcttgttggtgcatactcccgactacgtggaggatgtttcggtggccaacacggacatcgctttggcgggacatactcatggtggacaggtacgcgtattcggttacgccccgatacagaactcccactacggcacccgctttctgaccggactggcgtacaattcaactaaaatgccattgattgttactaatgggatcggtacttctcagatgcctgtacgaatcggtgctccggcagaaatcataatgattacgcttcatcgtctcaaagagtagatacacttttaggtacgactttctgatgaactccacacttttaggtacgactttttgtgttattagcacatttttatgcatgactttttgttcttttctattcagttgcttatatttgcagttcataaatcgttgattataaaagaataaatatgagaagagatgcaatgcaacagttatatgactggaaggagaagacaacacggaaacctttgattgttcgtggtgcccggcaggtggggaagacatggttgatgaaagaatttgcatcatcagcttacagacagtttgcttacatcaattttgaggataacgaagtgatgaaagatgtttttcagaaagactttgatgtcgagcgcattctgatggctattcaattagtgaccggcatcgtagtagatactgagacattaattatttttgatgaaattcaggaagcgcctcgcggattgacggcattgaagtattttcaagaaaaagctcctcagtatcatgtggttgcagcaggttccctccttggcattgccatgcatagcaatgattcttttcccgtcgggaaggtcgattttatggatttatatcctctttctttttcggagtttttggaggctgtcgggcaagaggcttttgcccgtttacttgcaaaaaaagactgggggctgatcgctgcttttcgttctaaattgatagatttgctcaaacagtattattatgtcggaggaatgcctgaagttgtgaatgcctttattaatcataaagactatgccgaagtgcgacagctacagcagacaattctggattcttatgatcgtgatttctccaaacatgctcctattgccgaagtgcctcggattcgtatgatttggcgttctgttccggctcaattggctaaggaaaataagaagtttatttatggtgtcgtgaaggaaggagccagagcgaaagattttgagttggctattgagtggctgattgatgcaggacttatttacaaggttagccgagtgaaaaaagccggaatcccattgtcggcttatgaggacttttcggcatttaaattatttttgttagataccggattaatgggagctatgagcgggcttccaccgcaagcgttattggaggggaatgtgttgtttagtgattataaaggagctattacagagcagtatgtattacaacaattgaagtcagtgaaaggactgagtatttactactggtcttcggatacatccagaggagaactggatttccttttacaaaaagatgttagcgtcatccctgttgaagtaaaagctgaggaaaatctgcaatcgaagagtttgcgtttcttcgtagagaaaaatgcgggattacacggagtacgattttctatgtcagattatcggaagcaagagtggatgattaattatccgttatactctgtcggatatattctctaatatactcccaaacctttggatgcaagaagtatcttacatctttcttctcatcaagtgcctgacggataaacgtcgaacttatttcaaaggtaggcgaatggaccagacggactgtttcgggcagcccgttttcatttaccggaaatccggggcggggatagataagaatacggttttctttgatgatgcgctccgattgataccagcggtcgaagcgggcccagttatccgagccgataattaagtagaagtcccgttccggataggtttcatgtagcttttccaacgtatgtacgctgtatgaagggcggggcagatgaaactcgaagtctgaagagcggaagcggggatattcttctgtggcaagttctactaaccggagacgcaggtcgtcaggccatagctccgtccctgctttcagcgggttttgcgggctgaccataaaccaaacttcatccagttcttcatattcgcaaagatagttggccaaggccagatgtccgatgtgtaccggattgaatgacccgctgaagattccggtttttagtttattgctctctgccattctcatcttctcgtttttacttttttcttcttgatgccttcttatctttctattctttgttctttttttgctcttttgggttctcttttagactttctttttcagccttgactttctgtcatcttcttggcttccctttccattctcagcttttttctccattttggaaaaacgatagcctgcctcacagcaattaagaaaaagatgccggcggcaatccaaaaatgcagataaagtgaaaggatgccgaacactatatctacaatgccgataatgccgcacagatacatgaatttttcggtcgatccctccttcttttctatgctctctattcgttttttcagagattctttcattccttattcagaaattctttgataacctccagcgtctcagcctttgccgcttccagatcatcattcacgatgacacgatcaaactggggagcaaaagtcatttcgtattccgcctttgcgatgcggcattcgattacttcgggctcatccgtgccccgacccgtcagccggcaacggagttcttcgatggagggcggctgtacaaagatggacaatgcacgctcaccgtaatactttttgatgttgcatccgcctactacatccaagtcgaatactacgttctgccccttctccaactgcttttccacttgttctttcagcgttccgtaataccgatccttgtatacttcttcgtattccaaaaactcgttgttctcaatgcgacaacggaactcttcgggagtaaggaagaaatattcgaccccgtgtttctccgtcccgcgcggtgggcggctggttgcagaaatggagaacgcgagatttaagttctgcgtcagcagatagttgataatagtcgatttgcccgaaccggacggggcagaaaaaataattaacttgccagtcatttgtttaattgagaattgaaagttgaaaactgaaaatgtcgacattttcaattttcaacttactattaaataattacattacgttcagcacctgttccttgatctgttccagttcatctttcatttgcacaacgattttctgcatttcggcatggttggacttgctgccaagcgtattgatttcccgtcccatttcctgagcgatgaaaccgagctttttgccttgtccgttgccgctttccagcgtgctgatgaaatatttcaggtggttggtgaggcgttgtttttcctcgttgacatccagcttttcgatgtagtagatcagctcttgttccagtcggttcttgtcgtagtccgtgttcagcgtcttttcgagcgcgtcggtgatacgttccttgactttctccacccgttctttttcgtaaggagttatcttttcgagcagcagtgcgatgttagctatcttttcgcggaacttcttttccagtgcggcgccttcctgtttgcggaagtctaccagatgaccgattgcttcgagaacggtggcacgtaccatttcccattcttcttccgtcaactcttggatttcagtcttagacataacgtccggcatacggagcaacgtctgaaaccagtcggtggggacggggatgccgagattttccgagatcgcctgaatctgtttgtagtagccttccaccaacacttggttgataggagtcgcgctttccgcactctcttttttctctatccagaggctgaagtccacctttccacgctccagcactttggagatttcgttgcggatctcgatctctttttcacgataagccggagcgatgcgagtggaaagatccattgctttgctgttgagcgacttgatttctacgtttatctttttatctggaagttcggccgtagctttgccgtatcctgtcatcgactgtatcatatacttaaagttttgtgcaaaagtacacgaatattttaagaattggaaataatcatgtaaatttgcgacaatttaataagctgatttttatgtcgtgtatactgaatattgaaacctctaccactgtttgctcggtagcggcaagtcaagacggacagacgatttttgtgaaagaagacttgaagggcccttcacacgccgtgtctttgggagtatttgttgatgaagcgttgtcgttcattgatagtcatgccatacctttagatgcagttgcagtgagttgcggtccgggatcatacacaggattgcggattggagtttcgatggcaaaaggcatttgttacggacggaatgtacccttgatcggtcttcctacgctcgaagtgctgagtgtgcccgtgttgctgtatcacgatttgccggaagatgcgttgctctgcccgatgctcgatgcccgccgtatggaagtgtacgctgccgtttacgaccgtgccttgaacgtgaagcgtgctatcgccgccgatattgtcgatgagaattcctatctggagtttctgaacgaagcgcccgtttatttctacggaaatggagccgccaaatgtcgtgagaagattacgcatccgaatgcgcattttatcgatgacatccatccgttggcgaagatgatgtatccgctggcagaaaaagcagttgccagagaagactataaagatgtggcctacttcgaacctttctatctgaaagaatttgtagcctcgttgccgaagaagtcgcttcttgaataacgcacttcagtagaaaaaagtgcctcagtaagtgaaccgcctttggcgggaaacagtgattagtgagtgaccgtcgtcctccgacttttaatttttaatttcaaaacttttaatttaaaagatgcaatacaatacccagcagaaaagaatgccgcttcccgagtacggccgcagcatacagaacatggtagattatgcgttgaccattcaggaccgtgccgagcgtcagcgttgtgctaacacaattatcaacattatgggaaatatgttcccccatttgcgtgatgtgcccgatttcaagcataaactttgggatcacctggccatcatgtccggttttgagctggatattgactatccctacgaaatcatccgcgaagacaacctggtgaccaagccggaaccgatcccatattctactacccgcatgcgctaccgccactacggacacacgctggaagtgctgatcaagaaagcctgcgaacttcccgaaggaaacgacaagagaaatctgacagccatgatctgcaaccacatgaagaaagactacatggcatggaacaaagataccgtagacgatcgcaaaattgcggaagacctctacgaactttccggcggcaaactccaactgacagacgacatcgtccgactgatggcagaacgtctgaaccagaactaccgcccaaaggtgaactacaataataatcggaataataatccgcggagaagatattgaagtattaggtattaagtattaagtattagcgcggcgatgttgtttgctgtatgagattttgcacttgcggtctaatacctaatacttaatacctaatacctaatacttattacttaatacttaaaataaatggcttcatttgtaattgaaggaggacatcggcttagcggggagattcatccgcaaggggccaaaaacgaagttttgcagattatctgtgccacgttgctgactgctgaggaagtgacggtgaacaatatacctgacattctggatgtcaacaatctgattcagcttatgcgggagatgggagtgacggttgcaaaggaaggcattgatacttacagttttaaggcggagaacgtcgatctggcttatttggagagtgataagttcttgaagaagtgttcgagccttcgggggtcggtgatgctgatcggtccgatggtggcacgtttcgggaaggcgttgatctcgaagccgggcggagataagattggtcgccgtcgtctggacacccactttgtggggattcagaatttgggagctgacttccgttatgacgagtcgcggggcatctatgagataacggccgacaggcttcagggcagctatatgctgcttgatgaagcgtccgtgaccggtacagccaacattctgatggctgccgtactggcaaaaggcactaccaccatttacaatgccgcctgcgaaccctacttgcagcagctctgccgtatgctcaaccggatgggagcaaagatcagcggcatcgcttccaatctgctcaccatcgagggcgtggaagaactgcacggcacacagcataccgtattgcccgacatgattgaagtcgggagcttcatcggcatggctgccatgaccaaaagcgaaataaccattaaaaacgtttcctacgagaacctcggcatcatccccgaaagtttccgccggttgggcatcaaactggagcagaggggagacgatatctacgtccccgcacaggaaacatacgaaatagaatcattcatcgacggctccatcatgaccattgccgacgccccctggccgggactgacacccgacttgctgagcgtgatgctcgtagtggccacccaagccaaaggaagcgtactgatccatcagaagatgttcgaaagccgcctgttctttgtagacaagctcatcgacatgggggctcagatcatcctttgtgaccctcaccgtgccgtagtaatcggacataaccacggcttcaagctgcgcggcgcccgactgacttcgcccgatatccgtgcgggaatcgcccttctcatcgccgccatgagcgccgaaggaaccagcacgatcagcaatatcgaacagatagaccgtggctaccagaacatcgaaggacgacttaacgccatcggcgccagaatcactcgaatatgataaagaaagaagaagtatataaaatcggactattcaacaagccgcacggcattcacggcgagttgcagtttaccttcacggacgacatcttcgaccgtgtggactgcgattatctgatctgcctgctcgacggtattttcgtaccgtttttcatcgaagaataccgtttccgttcggactccaccgcactggtgaagcttgaaggcatagaaacggcggaacgcgcgcgtatgttcaccaatgtcgaagtctacttccctgtgaagcacgcggaagaggcggaagacggcgaactgtcgtggaacttcttcgtcggtttccgcatggaagacgttcgtcacggcgagctgggcgaagtggtcgaagtggataccgcgacggtgaataccctttttgtggtcgaacaggaggacggagaagaactcctcattcctgcacaggaagaatttatagtggagatcaatcaggaaaagaagctcattacagtcgagcttcccgaaggattgttgaatttggaagatttggaggaagattaataattaataaagatgccaagaaaacggagtaaagcattttggaacaatttcaagttcaagtataaactcaccattatcaatgagaatacgcttgaagaaatcgtggggcttcgggtatccaagctgaacgggctttcggtgctgttgtccgtgctggcggtgctttttctgattgctgcctgcatcattgccttcacccctttgcgcaattacctccccggatatatgaacagtgaagtccgcagtcagatcgtggacaacgcgctccgtgtggattccttgcaggaactgctcaacaggcagaacctctacatcatgaacatacaggatattttcagcggaaaagtgcccatagacagcgtgcagacgctcgactcgctgaccgccgcccgcgaagacaccctgatggaacgtaccagacgtgaagaggaatttcgccgccaatacgaagaaaatgaaaaatataatctgactacgatcgtttcgcagccggatgtcaacggactgatcctgtatcgtccgacccgtggaatggtttccgaccatttcaacaccgataagaaacactttggaacggatattgccgccaaccccaatgaaagcgtgctggcaaccatggacggcaccgtctttctgagcacctacaccgccgaaaccggttacgtgataggcgtacagcacagtcaggatttcgtctcgatctacaagcactgcggctcgctgctgaaaaaagaaggcgaccgcgtgaaaggaggcgaagccatcgcactggtgggaaacagcggaacgctcagcacagggccgcatctccacttcgaactgtggtacaagggacatcctgtcaatccggagaagtacatcgtgttttaaagccaatgacgagaagtgggatatacgattataagtgacaagtgacagaggaattagataataatggattcagaaaagaagaataagaagaaacaaatagctattttaggctctacgggctctatcgggacgcaggcgttgcaggtgatcgaagaacaccccgacctctacgaagcctatgccctgacggccaacaaccgggtagaactgctgattgcacaggcacgcaagttccagccggaagtggtggtgatagccaacgaagaaaagtacgcccaactgaaggaagcgctgagcgaccttccgatcaaagtatatgccggaatcgacgcggtctgtcagatcgtggaggccggaccggtagatatggtgctgacggcaatggtgggctatgccggactgaagccgacgatcaacgccattcgtgccaagaaagccattgcgcttgccaataaggagacgcttgtggtggcgggagaactgatcaaccaactggcacagcaataccacactcccattttgccggtggactctgaacactcggcagtcttccagtgtttagctggagaagtcgggaacccgattgagaaggtgatactgaccgcttccggtggtccgtttcggacctgcacgctggagcagctgaagtccgtcaccaagacacaggcattgaaacatcccaactgggagatgggagccaagatcaccattgactccgcatccatgatgaacaaaggctttgaggtcatcgaggcgaaatggctgttcggcgtgcagcccagccagatcgaggtggtggtgcatccgcagtcggtcattcattccatggtgcagtttgaggacggtgccgtcaaggcacagctaggcatgccggatatgcgtctgcccatccagtatgcgttctcgtatcccgaccgtatctgctcttctttcgacaggctcgacttcacccagtgcacgaacctgacgttcgagcaaccggatacgaagcgtttccgcaaccttgccctggcttacgaggcgatgtatcggggcggaaatatgccttgcattgtcaatgccgccaacgaagtagtggtagccgctttcctccgggacggcatcagcttcctcggtatgagcgatgtgatcgaaaagacaatggaacgtgccgcgtttgtagccgctcctgcttacgacgactatgtggctaccgacgccgaagcgcggagaatagctgcggagctgattccgtgatagcaccggagctgatttcgtgaacaatgaaaaatataaataagtaatataaattagaaagcgcctcggttttcctcttatgagcagagggtttggatgaggctttaaattgtaaatagactatatggaaacatttttaattcgtgccctgcaactgataatgagcttatccttgctcgttattattcatgaaggcgggcatttcctttttgcccggttgttcaaggtgcgtgtagaaaaattctgcttgttctttgacccgtggtttaccttgttcaagttcaaacccaagagaagtgatacggagtatgcagtaggatggctgccgctgggcggttacgtcaagatagccggaatgatagacgagtcgatggataccgaacagatgaaacagcctgagcagccttgggagttccgttccaagccggcttggcaacgtcttctgatcatggtgggcggtgtgctgttcaacttcctgttggcgctctttatttattcaatgattcttttcgcttggggcgaccagtatataaaggtccaagaagctccccttggtatggacttcaacgaaacggcgaaagcggtcggttttcaggatggcgacatccttttgtctgccgacaatgtgcctttcgtacgttatgacggcgatatgctgagtcagatagccgatgcccgtgaggtatcagtgcttcgtgacggcaagaaagcctccgtctacattcccgaagacatgatgcagcgcctgatggcggacagcgttcgtttcgcttctttccgtttcccgtatgtgattgacagcgtgatggttaattctcccgctgcgcaggcaggcattctgccgggcgacagtatcatcgcattggacggaaaatccatctccttctctgatttcaagcagacgatggcggaacgcaagaaaaacgccgaagcacttctgaaagacagcatcgaccctcgtctgattacgctgacgtatgtgcgtggcggtgtgaccgatacgacttccctgcgcgtggattccgcttatctgatgggcgtagttgccagtctgacaacggatcgtctgttgcctatggtgaaaaaggaatacacattctttgaatctttccccgcaggcgtatctttgggtgtgaagacattgaaaggatacgtcggcaacatgaaatatctcttctcgaaagaaggagccaaacagttgggcggcttcggcactatcggaagcattttccctgctacgtgggactggcaccagttctggtacatgaccgccttcctttccatcatccttgccttcatgaacattcttccgatccccgcattggacggcggacacgtgctcttcctcttctacgagatgatagcccgtcgtaaaccgagtgacaagtttatggagtacgctcagatgaccggtatggtgcttctgttcggcttgctgatttgggcaaacttcaatgacatattgaggttcttcttctaagcagggaccggcaaggcatacacatccgtcttcccgcgtgcagaccggaagttgtcagaacagcaatcccggcgacagcggactgctggcggataaaaggaggacgtcggcgatgaagcaatgtatattgctgaaatacagtaaaatagaacgtactatttatcatatatagaaacggcgctttaacactacgttaaagcgccgtttctatatacgataaatgccttagtctgccaacgatgatacgccctttctcctttgggctctctggatgcccggagacgaatgttaaatcattaacattctctgggttagccaaaaagctggttgggctctatatcgcacggttttgagctaaatgataatcaatagtatcttgaatggggctgactaaaaagtcaatagtatcttaaatctcctccttcgggaaggaggagtacccgtagggggaggtggtaggtgaacacataaccctatcattacaaagaaataggaataaacattctttttcctaccacctcggtcttcgaccactcttcccgaaggaggagattcgagatagaatcgactttttagtcacccccaatggagatactactgtttgattcattttccgttcggaaagaaacaaactggaaacaaccagttttccggattgatcccattttcttctcccatgattttcgcttcggatgacagaaatttctgttcgtcatgactgattcgtttctcttttcagcgtagacggttgcgacaaccgcagactgctgacaatcgccgccacaacagcaaacccacttccgaccatgaggcagaccgccgtactccggtcgtgcacgacaaaactgaaaagcaacgctaccaacgtagtaccgaacgtttgtcccagcaaccgtgccatccccagcattccacttgcaccgcccgaacgtttcgttggggcggaagagataatcgtactgttattgggtgtctgaaacaatccgaaaccggctccgcaaagcatcagacgaagaattatactgatatcggacgattcggcagtaagccccgaaagtgaaaaaagtccgacagcaaacaaggccatcccgatactccccaatatccccggatgaatgcgttccaccagataacctgccaacggtgccgtcacaagagtcgccaacggccacggagtcagcagcaatcctgtcatgacctcgctgtgacccaacgtattctgaaggaaaaacgggagagataccatggccgccatctgagcgataaacgaacagatagacgtcagaatcgaaagccggaaaatcggtatccgcaataagtccagtggcagcaacggagtcgtctgagtcagttgcctccgtacgtaaaacgttcctacgatggccaatatgatcaattgcagcacaaggaaatccatctcctcatgatgcgcaaatccgtccagcgtataaatcagtaacccgaatgtgaccgcattggctatcgcactcacgaagtcaaacttccgcttcgaccgctcttcctgtctcggcaaatgcttgattcccagcagcagtgccgtaatccccagcggtacattgatggcaaacagccagtgccagctggctatcgaaagtatgccgcttgccaccgacggaccggcagccgccgatatcgccactaccatcgcattgattcccattccccgcccaatctggcttttcggatatacgtagcgcaactgcgccgtattcacacttgtgatggccgacgcactgaatccctgaaagatacgtgcaatcgtcagcgtccagaatgaatcggacaaggcgcaaatcagcgaagtgatgcaaaacagcccaatgcccgacaggaacactttccgataaccgataatctcccccaaagaagagaaagacagcagcgaaacaacgatcgccaactgataaccgtttataatccatgtagttacagcaggcgaagttccgaaatcgtgcgaaagcgtagggagtacgatgttgataatattcacgtcgagcaccgacatacaaagtgcaaatccgatggaaaccaccgcccagatacgtctcggcattggcagtccatcggtttcatctatagaagtggtattattggcttgtatcataaaaaacttattcttgtagaaccttattttgtctgtaaatgtaaacaaaacaaagaagtacgtgtttcaatcttctttgaaatataagtttttttagcgcaggagacaacgcccgcagcagttcatagtagaccacgcccacaacaattcgcagcagctccccccgcactaaactaatacaaaacctcccccaccattattacctataacctattacttattacctattctcaatatcctctgattgctgcttccccgaaattccagataaggcgaaaagagcgcctgttcgaaacgcccgtccaccagcacatctatgtagtcgagcacagccttcaaacgcggattagcctgaatctcttcgtacgtatatcccgtatagcaccagatattcagccccgtttcctcctttacccttttgacaaaaagcaggaaagcctccggattataaaacggatctcctcccgaaaaagtaaccccgtccagcaatggattggctttaatctcccgaatgatcgattgaatcctttcctccgtcagcagttctcccgcccgcggattccagctctccggattgtgacagccgacgcagtgatgagaacaccccgcaagataaatcgaataccggatgccttcaccgtcaacaatcgtttcgggataagtcgataataagtggagaactgaaagtggagaattgagagtgttcatcttaaaataaaaataaatgggtataaataatatacaagaaggaagagtaaagccccgcccgccatcacacagcgcagccaactctcaactctcccttctcaactctcaacttttataagtgcttcacacgatccttttcttccgcccgtttggcagagttccaggagctgaggtcacctgtcaggtatccggtgatgcgacgcatacgtaagatgttttcgctttggcataccgggcatttatcgaagattactcctttgtatccacagttgtggcaggtatccaccggatgattgatggagccgtagccgatgccctcgtcgtgcatgacctttacgatcttcgcaatggcacgtacattcttctgagcttccccgtccaattccacatacgtaatgtgcccgccgcgggtaatggcgtggaaaggcgcttcgcacctgatcttttcggtgatgctgatcggttccttcacatccacatggaaggaattgacgtagtaatcgcggtccgtcacgccggggattttgccgtatttccggcggtctatcttggtgaaacgtcccgaaagtccttcggcaggtgtggcaagtacggaataattcaggttatatttctctttatattcgtctaccactttgttcatttccattacagcttcgtacagcgtgtcccatgccttctggctgtgtccgtgaccttctccgtaaagtgccaccattgcattgtgtccgccgataaagccgatgcccagcgtaccgctgcgtaacgcatcgcccacttgctcgttcggattcagtgcgccgccgcctttccatacgtcatttcccatcatgaaggggaactggcgtgccagtgcggtgcgttgatactggtagcgctcgtacagctgatcggctacaagagtcgccatattgcggactgactccatgaaaatctctttcgctttctgttcgatggcatccttgttgcgttcaccctcaatcagattttccgccttgatgcgtgcttcgatggcgagacgcggcatgttcagtgtggtgaatgaaaggtttccgcgtcccaaagatgatttttctcctgccacattctcaaatacacgggtgcggcatcccattgtagccaactcgtagatataccgtttcggatcgtccgctttccatttctcgttcttgttgaaaggcgtgtccaggaacatgaagttcgggaaaagcgctttcgatgtagtctgacaagctcttagcagcagatcgaagttcggagcttcgtaagttccccgcatggcgtcttcgatgttttccgcacccatcgctttctcgaagtccttttcggagtaagaaactccgtcctttactttgaatatctggatcgggaatacggggacttcgccacgtgttccgagtccttcgatggtggctttcagcagttcctcgatcacgaggcggccttcggcggaagtatccgttccgtagttgatggagctgaataccacttggttacctccacgggagtgcatggtgttcagattgtggataaatccttccattgcctgatgcgtatccttctttgtctgctggtacgctttctctgcgatgcgtgtcaggtgttccttgtcaataatgatttgcagggctatcagggcgatgcgcaatgtctcgcgttctgcttcggtcgatttgatagaaggtagatgttccttgattaaggtacggattgctttctcgtccgcctgtgttccgttttccatcgccacgtagaagttgatgaacgaagccagatgtttgcggaaagactttgccaccccttttgccatgaagaagtcgaaggcggggattgcctgtccgccgtgctgctcgttctggttggtctggaagatgatggtggcaagcgtagcataactttggatgctttgcggtgtgcggatgctgccgttcttggtgcggaagccacgttcaaagagatcgtccatgtcatattggatgcaggtggtcgtctttgtcgggtagtaatcgaggtcgtgaatatggatatcgcccaactggtgcgcttcggcaaaacgtttcggcaacagatatttataggtatagtctttggtgacttccgatgcgaatgtcatcatttgtccggcaggcgtgtggctgctcatattggcgttgctcaggttcacgtcgttcttgtcgatggcgacgatgccgtccatcacgtgcttcatctgggttttcttgtcccgctccgtgttccgccattcgcggtagatgatgtacttcttggctacttcggggcgtaccttcatcaatgccttttctactaagtcctgaatttcctccacggtgatcgtggggttagtgaactgactgattacactcatcgtgacgtcagcaatcagttgctgctcgtcctgaatccctgtcgcactgaatgctttaccgatcgcattcttgatcttactgatagagaaatcttctcttttaccatctcgtttgatgatacaaatttccgcgtagttcataactttaactcccgaaagtgattaataatatgtttatttgactccggcaggtcttctgacttatccctcccccgcagcgccttcccacatctggatgcagtgacatagtgtgcggattcacagagaattacagcagcgggtactgtcgccgatttgcacagcgttccctcattgactaaacctctttttagttccgaaaccggatacaaagataaaggatattgtgatagcttggataggatttaacattaaatttcgggaaacttttctttctgcctgatacagaaagttttccgttttggataacttttaagaaatgattcttgcaggaaatattagtttttcttctctgttatattgaaatagtcggactctcttttaagtgtcccatgccccataagtgtacttattaaaggactcacgcttttatcagacttaaaaaaagatagactaaatgaagattttaaaagatttgcatactggtagaaagaagttttccagagttgagcggatgcattttttgcaagagctggaagaagaactgaaagtttattatctctcctatacagagacagtagataggccttattccgaacaggaacaagagattattgtccggattatcaagatgctgattcgtcagcttcggggtacatccaagtttcagttgtttagcaggagaggtacaagacgtaagtccgaagatccggatgatgtggaagagcgggaagagcggcgaaaggaacagacagacgagatacgtttgaaacataccaacctttactcgtacaatcctctttccaagaagtataaagcgaggaaagaagaactgcttcggaacctgaaaagggagttctaatcttccggatgtttcattgagaacgtccgggaagtaacaaataagagtagaccggcaaatgcgtatgtattgtgagtcccttgcgtttgctgagcctgctcttatttgttttagaattagccaagaaaaaataccctgacatgtaaatgttttagtttcatgccagggtaataatctaatagttattgttcagtcggtgacttttatcaagagaccgttttaacaatatgcaatgtcagtaacggacggaatatccgatatgatgtactccatacattctttactccttctactgctatcggattgtttttagacttttgaatgtatttcagcagaaccttccgttgctggcgattcaaaatgtctatgtttgtagcccatagcataagtccttcttccaacgttgtcacttcaaactgatatgaggcattgtaattacgaatataggtaatgaaagtaaaggttgctttctctgatagaggaaacactgtatcgctcatgtcggtttctatcatgtttacatcatataagtacattaacttgtaatatttcctatcgccacatccctcgtggtatttttttgctatattcgcattgtaaagagatattagatcatcaattaaaaagaaatcacgccagacgttttttacgcagtctaattttactgggccattgtcatgatagcattccagagattcacgaataagtaaagacttcatttttgaagatatatgagacgtgtcatgaactaattcacgaaataaatcattagtcggcatttctgattgatactgatgaacaaagcaatgcttatcgttggcattaactaagaaagtaaatgttttcataatttcatttatttcatggttgtttctgagacttgaatctaccctaatgtaggaatatattgttctatgctaggatgttttattagtcgttttttttactgtctctactatattaagaagcaaaagagtactaaatacaataaaacatgtacaccaaacattacttagaccatttaatttggtaggaggatctatatcaccatatttgatattcttcttaaatgacttcaactgtttatctgtaaaaaaatcgacattatttatccataagttcaaggcttcttctaatgtctttgctacatactgactaatgtatgtcccacctttatagtcagcaataaatgtaaatagtttcattttaattacctcctctacctctttgatggtcatggtctcctgcataatccatctgttttttatagtgatctctttgttttttcaatgtttctaattcttttttctctttcgcagttttatttgttttagattttaaattatcatatttctcttttgctgtactataatcatttgcagcttgttgtcttttatcaatattcgaatgcttttcattcttcccgctagactttgaatacccgcttccgttattactaccttcgctaactcttccttttttggagaatagcttcatgaatccacttgttcccatcaatgaaccgtgagtgatatcatacacgcctttcgcggtaacccccaaagaaattcctgcggtttccggactgagtgccattcctcctgcagcttcttcgaaaccattaacaatctctgcggctcctgcaaaaatacttatgatatcaccaacatcctgtcctgcgttgtaggcagatgcgttgctgtatattccggtttcacggagtgacgtttgtccaagcagtatgttatctgccatagcccgtgcagctccattggtaaaacttagagtacccttaaagacgttgcttaatcctctgcttattcctccccatgtgggccacattccattgggatctactaataggataggattgttcaaacagtaagtgtatggactaatcttatagtacttttccgtcatcaggtccatcgtatgccatcttcccaataccgggtcatactgccttgctccgtagtcgtacaagttcaatccgttctttgtatccagttcctttccgttatacttaaaaggttgaacagatgaatttgaagcgaatattcctccgaacggataatagtggttcacttcttctatcattccatcttggctggcaaccactctgttgtttccttgatggtcttggatgtagtagtggaactttttatctgctatagagaaatatccctgttcggtcaatagcttgtcccggcttccattttcatagatcacattgccgcagtagtcggttgtagtggtgtttcctgcgattatatgtgtagtttggagtttagttccgtctgcgctatataggtaagaaatttcactaccgtctttaaactgtatccgacgtggtaaatttaagaaattgtattggatatcagaaatgtttttattcaaatcttttgttaaattaccgtcttcgtcgtaggaatattccgtgtccagattcacaccgtccttgaactcgaaaccattcgcgtatgctgaacttgtggcgctgtctgtcactttcttgagctgattgcctgtgtaagtaagagataggtcgtcaattaatccgtaactgctttgtccggtttgcccataacgcttcagtcctgtgatgttgccatgtttgtcataaccggtcacttgttcattgaagtgatttgtattcgtcatcgaattgcttccttcactataattggcactggtcagcctgttgagcttatcgtatgaatattggtaattacgggtgattgactctttgtttgctttccacgtcatgctactgatatttccgccatactggggagtgccgggaccatcagtataatgtagcgtttgagagaagagagggctttcgatagacgttagccagttacggatattatacgtattggtcgttgtcagtgtggaagtgccgtctattcgggttaagcttttaatattgcctaagtcatcgtagagatagctcattttcgtagagtccttttcatttacgatttgtacagtttcagacaaacgtcctgcgtgattgtagctgtgtttggtttcttcgatcagctcggagttacttttggagtggatatgcttggtgtgcacaggctgtcccgtaaagttgtaagcagtgtatgtcttttcgtatcctcccagatgattggtcgattttatctgaatggcacggccgttataatcatagtaagtaacggtatagtcgtatcctgtcacagatccgtttttgtccagtcgagctgtcgcgtttccggtctgcaagccttgcgaactagtcgtatatctttctccgaactcgctgtttgcttcataattcaaactgctgttggaaatcagggtgccgttctgcatcttaaactgatagtcgtcataatatttggcggtaagcactgtggctgaattcagtgcgactccggttacggaataaccgagaagagaagcgttgttcgtacgttcacatttgacgcatgtattcagtatcgggttgttgaatgggtctatggcgtttttacaaatccccgtgatacattcgcgccccattgcgtcgggcaatgcgaattgccattcacctctttttcgttgttctcctgtttgggagaagataaggcggtctgccaagtcatagactttgtactcccaactgcagcccggtaacttggtgcctatgcaccggttacgcatatcatatttatagagataggcgtattgagctaaggatgcggaagtttgactcgaataactgctaccgcttacaagttgggcggataccataggtggaagcaccgcttttaaattatcgaactcatcataaagataataagtgtcgttattcgtcttactgccgttgttgtgctcaatttgccggctaagtactacttggtcgaatttattcttgaattccaatgtcacttgacgatcttcgttttcggtccgggtgacggatagctcggaagatttgcaattgccggctactttcagctccatgttttggttatctttttctgtcatttcaaaccgaaggcagttgagcgtatcatttccggcgaagttactcaggtagctgaatttggtacttgctttttgcgaacgccagtcgcttccgggaccatatacttcccgtactcttcccaaaggtgaatcttcgtagactttttctgaaaagtgataagtatattccttatagttaaaagcatagaaatcttgcagactttcggtaaacttccagtctatcatttctgtgttcgaaccttgtgcgtatggcaaatacgatttggcatcatctcttaacaagttatcataaacgatcggatggtatatactcttgttcttattggaagtacccacttctattttctgcgatggatatcccagaccgttgtagtaagtaatttcttttcttcccccacttcttgtgttatccagataattcgttgtggaaatatagttgtctcttccaataggtaatatttctattggaatgttttgaggtgactgtttgataatgaagtgtactggaaatgttgtttcgaatgttacatcaaaaaagagtacgacgaactcggatgatatgtctgaaattcctacccctgtgagccttaaacatcttcttaaatcttccgttattcttgaaggcacgagcctttcgatttctgcagtgaataagtgatttttgttttccatcgttactatccactgacctccgtattcgagatgtgaatctatagaagtcgttactctcaatcccagatcggataaagatatctctccatgtctactttcagctggcgttatttctatcggaaaatcctgaggggattctttgataacgaaccgtatcgtatctgtcggatcggccgttatgtgaaagtaaaggttgcatataccgtctgaattagaagtaaactcaactttggaaagtctcacgtacggacgcaattcttctgatatgcgtgaaggaacgaagtttttgatttctgcttcgttcaagctaaagttgttccttgctgttatcatccaagtatctccttcgtagagagtgctttcaggagaagatgtgacttttagccccatgttggtcatggatatttgcccggtttctgtcgccaatgcaggactggcgagtaagctgcatattaaagctgtaatataaataataattttcataaatttatctctttagaggttgtttgaatatttatatgaactaatcagttcgcccttatggtcggtcttttctatcagacgtccagaatcatcgtatttaaaataggtagaaacattcttgggatctctaattttgctgatacctatgtatgggatatattcataagtagtgataaatgatgccggtaattgcgttctcaaattttcaactttctgcatgtctgaatagctgggcttcgttgcgtctgccagtcttttgataagatcattccccaatagtcctgtaactgattcgtaatcgctgttcttgatttccgcaattgcatatttgcctttgtatccgtacaggtagacagtttctgttttgtctttttcgttacggatatgagtcgggttgctgtaagagtcgtatgccaggtatgtggttgcgggaatattagaaacatcggctactaactcgttgcccacattatggagtccttggtatgttgcagcatcagcatgttttcccagtatggatactttgtctttcactaagcttttgctgtctgcagtcagtaacttatagaaatatgtctcattctcagttacttttccgttttttatctttgtcacttccaatggatagtcggtgaagtgtagctgattcatctggtagaaagaactatagggaggtacaaatggaaatatcagcatgtccggcacgtatcgcgtcttttcttcgtatacatttccggctccgtcttcactggttttcagctttatctgtttgttgacggagttatattcgtatttatctttatactcaatagtgtttccattgtcatcgtaagtgatagtccgtttttccgaaagtaggttgctgtagaatttttgatagtaggtacctccgaaagcaaacctcaggaatcccagtgtagggtcgtctgaattatagtccatgacattagtagtggttatctccgtgatgagtatggaatctttctgtataggagtatattcgaatagttctttttgtttcacatgaccggcacagtcgaattgttctttacttaagagcattccgcgctttagtgcgtttgatgaacatggagtgtatggactataaggggtaccgacatgaggagggtattcacgggagaacttattattcaacatagctatgggatcttcgtccatataacctggtccgaaattgctgaatgtatggacagtatatccgtctatcagtttcccatttttgtcttcattgcactctatgactttagaatatccgatatactctccccgactgttgtaccagagcggattggatgcttgagacatgatggcattcaaggtataatattcgggtcctccgttttgtgatttgaggagattgtatagctgccaaccccaaaggtattgtggagtgaaagatagaataccggaagagacacctccctttgttgtcggtgtgaattcttttgtgtagtaatagtgctttcttgtcagtagttcatcattgctatcgtagttgttgatttctttgatacggagacctcccggatatgtataatctggagtgcctggataaggtaaatgggcactttgtactgttttccggtctgctgacaccatactggatatgacgttgggttcataaatgaattctgttcttccatgtgtggggtatgtgatggattttagcatttctgcagtcacacgaaatcctcccttgtctcccattcttttgttggtatactctttgccttcggctatctgcttgtcagcaaaaattgcattttcaaagaactctttgctgaaatagtatgagaaattttcaccgttattgaatccgaggttgtcatagtgtcctgtattatatccgggtaggtgattggggaaataatttagtgaataggtcgattgggttcctgatggagtcgttttagtcagtgttttcagttttaatcgctcagtggagctattagtgtaagtaaactgatagtttatcttatccaatattaccacggagtttagcttgtttaacgtgaaattcttttcttttgtaaaaaatgtagctggcccatggtccatacaggtttcccatgcatactgtgagtcatagggtaattgtgtacttggggagtaatgaaaccgggcaagtattttattgtctgttacatctttgactgttgcaagttgtacaggggctagtaattcataatcataactcattgctgtttgccagaatagagcatccaagcttatacagaaagacatatttccatttatttgaaacggcataatttcgtaggtgaattctatttcatgtcctgcaggagttatgattttggagagatgccaggtgatgggagcaggaaggtttaagaatcccttgaaaggtagattgtaatctgttttatcggttcctccaaatatgtatttataaccgtctggcgtggtcagtgtaaacgaatcaatcaaccaacatgataaagggttcttaaatccggttccttctgatctgcaatagttgtaaaattgagaaagtggactggtaagttgagaacgggtattattgtaagtattcgaggtaaattcaattttgatgtcagaatctgattgaaccatccacttgctcttttcttgactatacataaagcttccggtgtaaccgagaaagttaaattgatactcgtcttgggtattaatatagttgccggatactcttactagaatgtctgctgtggttaataaatcagcttcggtggttataggcttgtattcattgctagaactttcataagaaatatctggctcatttttaattatccgggtaatacatcctccgcattcaaggctccatcccaatcccacttcactgggtaggttgttgggttttacattataaatatgataattgaggttgattggaagttggatattatctcttaacttaaattcgtacaatgggatagagatattcggagttccggtatatagtccgacaggtattttaccttgagtgttggcattactgacacccggttgtggaaagccttgtgcccctgtcaacccaattactttctcaaattgcccttgcgctttcaggcaattacttgccaatagaaaagctatggtgaataatatatatttcattttcattattagtttattgatttttgtatactaagtccgccacaaatatttctgtatactgctgtggcagctgaaacagatatcttggtggcggacctcatttttgactttcttacagactcatcgcattagcgcccaacacgcctgctactgccgaagccaccgcgatgactactttcagaatcatatcccaaagggatttcttcattgccataatttacacacctcctttccgatactttaaaagattaattacttcctgaaaacgtctttatacctttgctcatttatattgtcctcacaggctttcctttacctcaaagcaaggacacgccttgatccactcttccggttcgatctccccatctccgttcagatccggactgagatcccggtgtccgcacacccggcagccggggaaacgttgctccaattgatgcaccagcaggcggagggcggcacgttgttccggcgtccgtgtatctgccgggcgtccccggcagtccagaccgccttcatagcagattccgatactcgacgcattgaatccttttgcatgtgccccgatgcgttcgatgggacgggtgagaagtgttgtcccgtctttgcggatatagtagtgataacctgttccgttgaatccccgtcgccgatgcagcgtctccagatcaaaggccgtcagtgtccggtccacccgtgttgcggaacagtggatcacgattaaatcgatctttctcatgattcgtcagatttgataaatacccggtttatgattgccttatacggttgggtccggagcttcttcgtcaccgtcatcggggtccggtttgggtttggggttttccggatcggtcttgtctccttcgctgctttccggtttgtacttgctgtagtccagcgttttcagtgcgtctttaatctcctttccggggcggaagcggacacgggcacctttgatcaatccttctttcacgtccttttggacgagtacgccattgctgcgcaaggtgacatagaacgaaccgatattccccaggcggacgatctctcctttcttgaaactgtcgatcatttccgtctgcagggcacgcagcacgcacactacgtctgcccagttcacggtactcgaacgctggatgcgttctgccatttcatctatatcgatctctccgctcgatttggcgagagcgtaatacaggtccggcttgtctttttccatcatgttcttgcggagcacgctggtgaatgaaaatacttttgccatttctttactggttttaagttcttgaataaatgataataaagtgttgcgtcacaggtggttccttgcttgtgacatgacaaaagtacggcggtggggatgggcgatgtctgtatttgtccgcaggtgtccgccgatgtctttttttatccgtaaatgtctgcggatgtctgttcttgtggtggtttgaggccgggattaaaaagaaattccctgatgcaagctgaataatactgttcagttcacatcagggaatggaacgattcgttcctgattggggtttaggactatgttatgctatgtcttattctttattgtctatgtcttgtaggtcccggctaagtttgttttccaactcttcgatactgggaagtccggatttgatatctttcggcagggcttgaccaagttcataatcggagattcctataggtttatgtacatcccgtaaggcgtattccgccataatctggtctttgttttgacagagtagcagtccgatggtcggattgtctccctcccggcaaaggatatcgtctacagccgagcaatagaaattgagtttgccgatatattcgggttgaaattctcctctcttaagttctacgaccagatatctatgcatgaaggcattgtacataagaatgtcaatgtagaaatctttttctgatacttcgatatggtattgcctgcccataaaggcgaagcctgcacccatttcgacgagaaacttctcgatatgttttataaggcccagttcaatatctcttttgtcgtactcttcggtgaacgtaagcatatcaaaaatataggggtcttttaatgtctcttttacttgcttggcttgtatttcgggaagagtggtgtcgaagttactagccaatgctccgtgagaatggtaatagtcttgcttgattgcctcgataaggaaatcccggctccaaccgtttttcaggcattggatcatgtaccagtagcgggcttttatgtctttagtgcgttgcattaaggttatattatgtgaccaacctaatttgctgacaggtaggactatttcattattgttcaaatacgaaacggcccgtttcgtatttgtaagttgctgattatattcattatagaactgtatcatgaactggcagttcctgacagagaatcctttcatctccggataatcattcttcaagtcattggcgagcttctccagggcattgtttccccaacctatttgtttttgactctcggacagtagtttgccaatatcccaatacattgaaagcatttcttcattggctgtgtaaatcgcctttttttgtgctagtagtactcttgcttttacttgtttgagtagatatgcatagttgaatgcatggttttgattttccattttgatttcgtttgttccgctaaagatactacttattattggttaatcgctccccctgttctaattattttctttgcttgtctgtatttgtccgcaggtgtccgccgatgtccttttttatccccaaaagtccgtatttacttcaataaatagcactgattattttacaaaacgaacttttattagtacctttataccattataaaatgctaataaaatgagattatgaaagaattaattgaagagaaaaagtttgaaatgagagcctatgacaaagtagagctggctctgctttattgtccgggacgttcggcagagtcagctcttaaaacactgatgagatggatcaagcaatgccagccgttgatgcaggcgttgggcggcatcggatataatgtgcggcggcatcgtttcctgcgtcaggaggtggaacagattgtccgtcatttgggcgagccttgaaaaaagagagaatgaagttctttatctctgctgctgttcatacgtctacttccggtttccagtatatcattcagcagattgttgtacttctctttctctcttcatgtatatgtctttcttctttccagtacttgatggaggcagtttcagtacttcttttccctgattcaagtacttgtacttctcggttcttgtacaacctttgcttctttcttgtacttgtttccggtacgtttctgaactctgtcgttacttcgatgtacgttttctataccaatttatcgggcgttttccgttactgccactgccaactgccacttagcgcttatttgtcagtgaattcttttattctgatatatttatctgtttgtttctcaatgtattttagctcgatgaggctttttagatatctacaggtacttcgttcgctgataccttctgtcagtgctttctctttaatctgtttgtaagtaaaaatcctaggtaggctctctacgaccgaccggattcggaagtatgactgcataggctgaggtttcattttctctcccggcagtgaggaggcgaccagcaggctgtggttgaggatggtttgtacgatctgcatggaggcatgaaaatcctcgtctgtacagatgtattccttcatctgcatggcaccttcatacttgcgcagggcggtgaagatggaagctatgcgtgccaccatcagtgcgccacggagtacgatagagcccggcgcgtccgcttgttcgctggccacttcgttgagcagacagtcgaagtaggcggtatgttcctcccattgtctgtcgctcagcgtgacttccgtaggagattgttggaagaagaagtacatctccaatacttccttgccgaatcccttgtagagtgtgatataatcttcctgtcctttgatgggggccgccgaacggtatttccatcgtgctccgcaggtgtagatgccgaaacggcagtaaagtccgttttccaaagagcggataaagttggccagttggctgggggtgccggacaggcagagtgccaggcgcggtacttctgcgcagatgagttcgccgtctaccttatagtccgtggctaccggttcatgatggtaggcggcacggaacacatcgtcgtgcttgccgtaatcctgcttgatggcgccggagatcatgtccaattcggtagcacagataatgagtccgaggtctccgttgattttcagccggcggataatttggtttctggaagtgctgggggcaccgcagaggtggtaatattccggtggttcgggcatgggagcaggggaggctgctgtagatttcgtcccttttttgatttgttggttggttcgttcccattccgtgagttcacggtcgtaggcatcctttttccgtttgttttctcctttcagataattctcgatttctcgtgggagcatgtttgccagtgtgagaagtcctttaccggtggcggggggagcaatgatcagggtgtagagctgcggactgtaaggacgctggtcgaaactgatgcggacttgtggcaggcatccgctcaggttggcgatcagtcctagaagcagtatatcgcgttcgcgtttgctgcgtgccggtttcatggctcttttcagaaagtcgggaagatggtcgtatacttggttaggaatgcagggagtagatcctcgtaattcttcattttttatggacaactcttcttctttccccgattcatttcccacagaaacaggcctaaaggtgtcagttgtcagtgttggcagtgaattgtgggtctcttggggtgcataagatagatcaacgtattgatatccagctgataagtcttttctgagttcttgcagcgtgtagccgtttctcacgatctctactgacataacagatgttaatttttcaaggtcttcttttgaaaatcccttacgtcgtgcgcttcttcccattgctagcatagactcgtggcggttgcctttctgccaggggtggtaatgggtgaagttacgggcgaaggtttcgatgtatccgcaggcttcggtagcgggagggaagggggaggaggagccgttactggtggtataaggggtgccgttgctgcctggaaggtttcttttatccttgatcaggttggttaacgaagggtcggtgtcgagttcttccctccacggataaggttcgggagtgggattgtagtaggcgtcggcatcccatacgcaagaacagggctgggtgatgcgggcgcattgttcgtcgcacggatgcccggcgatgcgttccagtgtctgctggcagatggcgtaggcgagaggatactcttccggggtgcgggcatcgagaaatacgacgactttgaggcctctgtcggagatactggtctgcgtgtaggccacgtaggggagagcacggaaaagggctttgacggcagatgtccgttcgttcaggtggtcgaggtcgtacatggctagtcggctcatcttttccagattggctgcggcatggctgcaatgcgggcggcagatgccctcgatgatgacgacaggcatggcgtcttttaccattttggcttcattgctgcggtcgggacggtcttgtagtttgcggtagcattcggtctgtgctttccaaagtgtgccgatggtttgcagataaaggttgtgcagggtgattatggtagactccttgctccaagtatttctaaaaaaagaaaattgaaattgtaaattttcggtttgtggtaagctttgcttttccatactatgtttttttgtttttattgataaatgatagtatgagataaagaagggagaatagtgctttcactattttattgagtgcagaatagtcggttccttaagtcggctgcaaagatagaccgggtgtaaggaagggtgaaatgttaaaaaggtgattttcctatgtgctatgcttggtttttatctggttacaactacttcaatgtcgtaattgatgaaaagtccgctttcaataacgcccgtgattgttttcagctgttcttccagcgaagcgtcaatataatggaaacgggtatcaaggataaagtttccgttttctgtcaaaataggaccgtcttttccgtgggcggggcgtagtgatatttcggaggcacccagtcggcgcagttctttttcgacgtatgacagtgcatgcgggaacacctctaccggtatggggaatttgcttcccaagatattgacaagtttgctgggatcgacgataatgaaggtttttccgctgcttctgatcagcagcttttctttgaacatggctccgccacgtccttttatcaggttgcggtcggggtctacctcatccgctccgtcgaatgtccagtcggggcgtttgtcccaaagggtggtctgcgggatgcccagttgtatgcaagtcatggagatttcctgagaggcgggaatcacttccagatataggtgctcttcgtgaatccgctttgccagctcaaacaaagtgaggtagacggtggaaccggagccggcccctatcacatcgcctgttttggctgtggcggcgatctcacgtgctacacgttctttcgcttctctgttgataatctcattggaccattggaggtctttgatcaggtgattttcccagttcatggttcttgcagttttagagtctctatttatataacgaatgaaagggagtgtttggttcaacaaaaacggaagaattaaaaaatagatggatgattggttggaatatagtttttaatatctatatttgtaacctaaaggtttctttttggaacctatgggtgaaacttaaaaataagaatatggactaaattctatggttatggaaaatattacgattgagaaaatggagattaaaaggtttaatgctcttttgatgcggacgattgtcggtatgttgtttatgggagtattaatgtgggagacattttgtcttgatactggcagaaagggatttttgggagagacatggtatatatttgcatttgcagttttgctgtatgtcgttgtagcgataagagcttccgatattttggagagaataaagaaagataagaaattaatgggagcattagatagtgaaatatattcggactataattctaaggctttgacagcaggcttttatgcggctatgcaaatgggattattagtttattgctttggagatttttttaatctctcggtacgtatgggtgctctggttatagtggtggtagctatgcttttctcagaaataagaagattgcttctgtataatccctataaagatggaaaataaagaactgctcaataaaataaaggtctacagggcgatgaagaatatcagccaggaagaactggctgtagccattggagtaacccgaaagacaatcaatacggtagagaccggaaagtttattccctctactgtccttgcgctgaggatagcacgttatttcggggttccggtggaagaaatttttgtgttgaatgatgaagcatcgtattgaaatgatgaactctgcctgacggctttcttttacttacaatatcagccagatcgctatgatatgccctatgcttcctcccaaacagaacagatggaacgtagcgtgcatatatggcttgcgcagcgaatagaacactgccccgatgatatacgaaactcctccgcctatcagccaccaaaaagccggaccggctcccatctctgctaaatgatccatcaaaggcttcatagccacgaggatgcaggctcccatagctatataacaagcggtttccagattactgtgttctttcagtttcttgaaactcagtataaaaccgacgatagccgacagccagacaaaagagaaaattccccatccccaaccgcctgcgtgcctcatgacgagcagtgtaaacggagtgtacgtccccgcaatgtgcagatagatagccccgtgatcgaatttgcgaagcaattccttcagcttacccggacggctgccgtgataccaggtggagctgacataagaagacagcatgccaaacaggtagacggttacacaagctaccgcccacttcggttcggcacccgccgccgctttcgcgagcaggaaatagccggctatgactccaagcagtatacctgctccgtgactgagcgtgtttgcccattcttcgacgttattgtatcttttattttccaatgtttcctttcggctttggttagagccgcaaaggtacacttttattttttcttgaaagccagagtgattttctttttaataggttgggttttctttctaaaccagttttccttcgatgaaggtggagctgattcgcgttcagctttgattgattttatcaaaaactctttcatctgattggctggtgggtatatccatacaaattcagagtctctataactttggtcagcttccgaaagaaaactccaatcttccgtgtcaaagttataaaacccaagattggtttctccgtgttcgtcacaagtcagtactatgactgaaaactcttcttcctcatgtctgggaagttctttctttttgtatatcttcatattctctttattataattttgttattaaattgttttgctacttgttttcggaaatcaaggaataacgcaagctggctgacgttttctttcagtgtcggattgcgtccgttggagtaataaggtatctggatgtcggcatacgccgttgcggtggtgtcgggagcaaagctggtcatggtgagctcttccttggagggttttccgtacttcagattcggtttgatcgtgttatcggactgctgtgaaaaggtagtcgatagcaagcataacagaaatgttgagaatatgaatagtcttttcatatcgggtgtgttttgtcttctccgacaaagataaaaaaaatagagaaaggtgtgtctcctttctctatttttatttcagttatgcggataaaagattataccaggtgtccgatccactcttcgcggtcgcccggaaggaggtcgatgacggggacttctaccatggtgtagcaccccggttgctgcttcatggaagcgcgtgccacgcacacaagtacctgtgcggtcagtgccggattgttgatgcgcatattgaactcgaacagctgattctgcgttttaccggaaactcccttgcgagtcagatttacaccgtgtcccatatcgagcagtgcgtctacgctgggcacaagttttacatgtgtctcgtcgttcacgaagtaagggtctgccttgatggctgcggctacttcttcaaacttgtatccgtctttcagttcgatatataccatgcggcggtggattcccgttccggtagggatcgtcatggagagggcggctttcactccgtcgatcgcttttacggctacggtgtgtcccatactcatgccgggaccgaagttggtgtaagtgatgcctttcggagcgattgcttcgagcatggtgcgtacgatcgagtcgcttcccggatcccatcctgcggagatgatggatacggctttgtgctctttggcggtggcatccagcgtgcggcgcaggtcaacgatgcctgtgtggatgtcgaagctgtccaccgtgttgattcccattgccaaatattctttcgcgtatttctcaacgctgcgggtcggtgtgcagaggatggccacttccactccttccagctctttgatatctttgactactgcatagtttgccaactcttccggcttgttctctgctcctgcacgacgaactactccggctatttcgaaatcaggcgctgcctgtagcgcttcaagtacatagtgtccgatattgccgtaaccgacaatggctgctcttacttttttcattcttttattggttttatatgaacatttttctttaattctgccacaaaagtaaacaaattactaggaagttttgtttactgcctgcattatttttaattttttcacctctgactgcgaggcggaaatgttgcgaaagtcttttcatctgtggtgaatttgtcttatctttgcaaggtatatgatagaatatgtaaaaggcgaacttgccgaacttagtccggcaaccgcagtaatcgactgtaacggggtaggctatgccgccaacatatccctgaatacttattcggctattcagggaaagaaaaactgtaagttatatatctatgaagctattcgggaggatgcgtatgtgctctacggatttgccgacaagcaggagcgggagattttcctgctgctcatttccgtgtcgggcatcggaggcaatacggcgcgtatgattctctccgccctttcgcctgccgaactggtgaatgtgatcagcaccgaaaatgcgaacttgctgaaaacggtgaaggggatcggactgaaaacagcgcagcgtgttattgtcgacctgaaagacaagataaagacgatgggagccaccgtggcaggaggaagcgcttctgccggaatgctgctgcaatctgccagcgtggaagtgcaggaggaagcggtagccgctctgactatgctcggctttgccgccgccccttcgcagaaagtggtgctggctatcctgaaggaagaaccggatgctccggtggagaaagtaataaaactggctttgaaaagactgtagaataggtaataagtaataggtaatagggcgtggagaaactaaaacaagcaacagaataataatgaaacaagggaaaatttatatgaaagcatggctggatcttcatggccgtgcaaaggtgttggcgacggatcactggtatcttgaatttgccaatcttttattgcctgtcatcagcgaatcttatttatataagtcggagacgcaggaaagccagaatcaggtgactctgatgctgactctttatctggaagactgtgtgacggacggaggtaactggcgccagtttatccgttggcataaaaggaattacggacgttacctgccgttttatgaattgtcggaaggttatctcaccgacgagatcaataaagaggatatcgctttcttgctgtggggaattaactcgccggtaggcgatgactttgacggtgtggagaatcccttggatgcggacttgctggagtttgccgatgtgatttatgcgcagttggaggatgttttcgagaaagcgcctatcagtgacggacttgccggagactggctgatggaatcggagttgatggagaagcagcggactgctttgcctgttgcctcgccgggcgatcagttgcccgtgaatgtggagcgcttcctgaaagcgagtggtggcgagccgttgatgttcttcgattcgtatgaggctttgaaactgttctttgtgcaggccctgcaatgggaggacgaagaagatgctctgttgcccgacttgaaggagttttcggatttcgtgatgtatgctaatccgaaaggtttgctgataggtccggatgtagcccgttactttgccgacaaacggaatccgctgtataatgcggaaatagctgaggaagaagcgtacgaacttttctgcgaggaagggctgtgcccgttcgatctgctgaagtacggcatggaacatgacctgctgccggaagcgcaattctctttcgagaacggaaaagagctgctgcacgaaaactgggactttattgcccgctggtttttgggtgagtattacgaaggagaatgatgctttgttaagttatgccaatcaaaaaaagtaacaatccgtttgccggaaaggcgaagcccgctgccggaaaaaagaaagggacggggaaacggataggtaagtcaaaggtggaaaaggctaataatcagttaaataggagagtgaaataagcctttggagactgcgccctttctacctgtcaggctacaccgttttatgtaggcaggctatgccgttttaggatgctggtttacgccgtttctccaaagtaaaagggtacgagcaagaaaacaatgctgcgtctctttaaagttggaatgaaatatcattactatttgtgtttaatgacaagtcggagaatagtctcttgaattgaaataaaaatcggtaagcgatgaaaaaataaatgtgctatctctgataaatacaaattttcatcgcttaccgttttttacttatccttttcggactgcttgatttattcttctccgatagcgcttttatcactttcccggaaagccgttactccgaaagaacctttattcttcggcagcttcttccagtgctttccgttctttcttcttattgataaatccgattttcagattggcgtcttcctgttctttcttgatttgttgtatggcggaaaggattttcgacagttcgtaaacgcctgctactgcctggcggtcggtcggactcatagtcgttgtgtatctacggtcgccgataaattccacacggatatttttgtccttgttgaggttcagaaattcgatcacgttaccgtcttctcccagtttgtaatcggctttttctattttctcgttcatatccgatgtttcgtagctgtccttcgaagtcggagtttcggcaaaactgccgtcgggggtcgtcactttgacgcctacatgatggatattgccggctccgcaataaatggaagtcatgctcatgattccctgttcgctcacttggaagcgaaggaaggaacgatggagattcttctcaatggcttgtgtaggccatatatagttgcctacttgctgatattcggcgtctttctccagggtgtacttgcctctgatggcgtcaaacgctgcttgctttgcctggagagcactgtccaaaaaggccagaatctcttgctgagccttgagttctacgtccagcatcaattcctgaccggctttgcgggcctcgaatgctttgggatacaaaatcttgatactgtcgatttgtgtctttgcttcttcgtagtcgccacgttcgtaggcagcacgggcaatcgtcagtttttcattggcttttttctcgatgccgtttccgcaggctgtcagtgccagcgtgccgcaaaagaagataatcagttttttcatcataccgtttacattttactattagacgatttgcgatggagatgggacgtgcagtgttcacgacttaccgctaactgttcgttacttgcggtttgccgttcgtgttacttgctgtttaccgttcctcgcccgttcatcgtttactttatagcgacaaaaatacaaatatatcccttatttttgtaattttgccccctcaaaacttgtattggcaataagtgtttgatgattatggaccgccggccggtgttttcatcaactatttaactgtctgttgccagtcgttaagcattaaaaagatgatagagttgactcaagaggaactgaaacagtattttagcgaaccgatcttcggacacattgccgaaaccgctgacgcactcggactggagtgttacgtggtgggcggttacgttcgtgatatttttctgcaacgtccctccaaagatatagatgtagtagtagtaggcagcggaatcgcaatggcggaagcacttggaaaacgcttggggcgtggtgcacacgtctctgttttcaagaatttcggtacggcacaagtgaaatataaaggtacggaagtagaatttgtaggcgcccgcaaagaatcctatcaacgggattcacggaagcccatcgtagaagacggaacactggaggacgatcagaaccgccgtgactttactattaacgcgatggctgtctgcctgaacaaagcacgctttggcgaactggttgacccgtttggcggcatggcggacatgaaggaaaagaccatccgcacaccgctcgatccggatatcacattcagtgacgacccgctgcgcatgatgcgttgcatccgctttgccacgcaactgaatttttatatcgatgacgatacgttcgaatcgctctgtcgtaacaaagaccggattgaaatcatatcccgtgaacggatcgcggatgaactgaacaaaattattctttcgcctatcccttcaaaaggctttgtagaactggaacgaagcggactgctgccgttaatttttccggaactggctgccttgcagggagtagaaacacgaaacggacggtcgcacaaggacaacttttaccatacactggaagtgctggacaatatcagcaaaaagacggataatctctggttacgttgggcagctttgctgcacgatatcgccaagcccgcaacgaaacgttgggagcctaaagcgggctggacgttccataatcataattttatcggtgagaagatgattccgaatattttccggaagatgaagttgccgatgaatgaaaagatgaagtatgtgcagaaaatggtcagcttgcacatgcgtcccattgtgatagcggatgatgtagtgacggattctgccgtacgccgtctgctttttgaggcgggggatgatatcgacgacttgatgacactttgcgaagcggatatcacttcgaaaaacatggagcgcaagcagcgttttctgaataacttccagctggttcgccaaaagttgaaagaccttgaagaaaaggaccgtgtccgtaatttccagcctccggtgagtggagaagagatcatggaaactttcggcttacagccctgtcgtgaagtcggtgctttgaaaagtgcgataaaggatgctattctggatggagttatccccaatgagtatgaggcagcccatgcttttatgctggaacgggcggcgaagatgggactgaagcctgtaaaatagcttttcttgttcaaattggggtgactaacaagtcgattctatctcaaatctcctccttcgggaaggaggagtggtcgcagaccgaggtggtaggagaaataatgtttgttcctattactttgtaaatgatagggttatgtattcacctaccacctccccctacgggtactcctccttcccgaaggaggagatttaagatactattgactttttagtcagtcccttatgacaattctataatttcttcgttgcagttagtcagtttctcaactccttcgtttgtcactacccaagagttttcgatacctacagggcctacaccgggaagaacgattttcggttcgagagcaaagaccatgcccggttccagctcctgcttgatgcgcggagcaagtacaggcgcttcgttgatttcaagtccgatgccgtgaccaatgaacttggcttgttgtcccgttcccataaacttatcggcaaaacctgcttgggtaaccatttcgattgcagtgttatacagcatttcgcagggaatgccgggtctggctatcgaagcgatcttttcctggatatccagacaaacttggtgagcggtatatgcttcttccgacaatttgccgatagagaacacacggctcatatcgcccatatatccgttgaagttgcctcccagatcgaccataacactttgtccttctttcagcggagtcttgtcagcgcctccgggcagggcaggatcgagtccgcgaccccctaaagcaaaatcgtagggagaaggataaccggcattatctccggtcagcacacttcccatgaagatttccatgctgcgtccaaacacgcggaagatgccgaggcaaccttgaaggcgcatcagacgttcgatttctatcgagaactcgatatctgtcattccggggtaatatgcgaacggaatctgttcgtatgccttggcatgtgccatgcccgaacgacggaacatttcgatttcgatagctgtcttcacgctgcgtgcctgacggatcagcggtgtcccgttcacgacttcagcgtccgggaacaaacctgccagacgaacatattcggtataaggaagttcgtcgccttccagcatcagtttagtgggcaaaggcagacctttttctttcagaatatcgacgatctgttccggcttgcggatggggaacgagtgttcgcctgtgatattgttgggccgcttgaaaaacagcagtgccggtgaatgaagagggagataaagatagccgctgactacacagccataggtgtagattaaatttgcattacaagtaatgagggcggcatcaatgccctgtgacaccatcagactgcgaatcttgtcgcggcggagttttaattcgggttgtagcattttttattgttattactgtataatgctacaaagataattaattccattgaagaaaataatgttaatctcaaaaaaatagcgctacccgcgtcctgtcacaggaggcgagcagcgcaaaccacaaatacaaatacaactaaacaaagtctcttttaaataacgccttgtcccatcatagcgtgagctactttcatgaatccggcaatgttagctcccttcacataattgatatatccgtcgggttctgtaccgtatttcacgcattgtgcatggataccgtgcatgatggcgtggagtttttcgtccacttcagcagcgctccagctcaggtgcatggcgttctgagacatttccagcccggaagtggcaacaccaccagcgttgactgccttacccggagcatacattattttcttttcgataaataagtcgattgcttccggtgtacatcccatgttggaaatttctccaatgcaaagaacgttattttttatgagattttgtgcatcttctccatttaattcgttctgagtagcgcaaggaagtgcaatatctgcttttacttcccacggacgcttgccttctacgaaggttgcacccggatatttttcggcgtaaggagcaacgatgtcattgcccgaagcccgaagttcgagcatataatctatcttttctccgctgatgccgtccggatcgtagatatatccgtccggtccggagatcgtaattactttggcacccaattcggtcgccttggtggcagcgccccaagctacgttaccgaagccggagatagcgactgtcttgcctttgatatctatattttttgcctgcaacatctgataaacgaagtacaaaccgccgaagccggtagcttccggacgaatcagcgaaccgccgaactccagtccttttccggtaaaggttcccgtaaattcgcgggtcagcttcttgtacataccgaacatataacctacttcgcgtccgcctacaccgatatcaccggcaggtacatccatgtccggtcccagatggcgccacaattcaagcataaacgcctgacagaaacgcatgatttcagcatcgctcttgccacggggcgagaagtccgaaccgcctttgccgccacccatcggaagggtagtcagcgcattcttgaatgtctgctcgaagccgaggaatttcaaaatggagaggttgacggaagcatggaaacggataccgcctttgtacggaccgattgcattgttgaactgtacacgataaccgagattggtctgaacttcccctttatcgtctacccaagtgacacggaaagtgaagatacgatcaggttctaccagtctttctatgatcttgaccttttcaaattcgggatgctgattgtatatatcttcgatcgaaagaagaacttcttttactgcttgaagatactctaattcaccggggtgctttgcctccaaagaggacatgattttctggatgttcatgatatcatattttaaaaggttattctgataaaatgtaaactgctcacactgcaaatataggaaaatttttcaaatatgattggttttatggtgatattttgattaaataatgataaaatgatagtgataggtaataagtaataggtaataagtaataagctgcgctgtaaaccgcatggttattacctgttacctattacttattacctattataaactttataaagaagatgatagcaaatgagatttaaaaaattaactttgcagggtaaacgtcaagtagactgtactatgaatcatttcattatggaataaaaaatagaaagagactatgctcagcaagtataaattaaaccagctttacttcaaagatacgcaattcgccaatttgatgacacggcggattttcaatgttctgttgattgccaacccgtatgacgctttcatgctggaagatgacggacgcattgatgaaaagatatttaatgaatatacatccttgtcacttcgttatccgcctcgtttctcacaggtttctacggaagaggaagcattgacgcagttggagaatatgtcattcgatctggtgatctgtatgccgagtacgggagacaatgacagttttgatatcgggcggcacatcaaagagaaatacgaacatattccgatcgttatcctgactcctttcagtcacggtattacaaagcggattatcaacgaagacctgagcgcatttgaatacgtattctgctggctgggcaataccgacctgttggtttctattatcaaactgatggaagataagatgaacctcgaacatgatgtgcaggaagtaggcgtgcagatgatacttttggtggaagatggcatccggttctattcttccattcttcccaacctgtataaattcgtgttgaagcagagccaggaattttctaccgaagctctgaatgcgcaccagcgcacgcttcgtatgcgtgggcgtcctaaaatcgttttggcgcgtacgtatcaggaagcgatggaaatctatcgcaaataccagaataatatattaggagtcattaccgacgtccgtttcccgaaagtggaacggggcgagaaagacggtctggcaggtatcaagctttgtgccgccatacgcaaaaacgatccgttcgtaccgttgattatccaatcctccgaatcggaaaactcttcgtatgccgccaaatacggtgccagctttatcgataagaattctaaaaagatggacgttgacctgcggcgcatcgtttccgataacttcgggttcggtgactttgtgttccgcaatccggagaccggagaagagattgcccgtgtgcggaacctgaaagagctgcagaatatcctgtttgccgtgcctgccgagtccttcttgtatcatatcagccggaatcacgtttcgcgctggctctattcgcgtgccatgtttccggtagccgagtttctgaagccgatcacgtggaccagtcttcaggacgtagatgcacaccgccggattatcttcgaggcgatcgtgaagtaccggaagatgaaaaatcagggagtggttgccgtcttcaaacgtgaccgtttcgaccgttactccaactttgcccgtatcggcgacggttcgctgggaggaaaaggccgtggccttgccttcattgataatatggtgaagcgttatcccgaatttgaagagttcgaaaatgcacgggtggcaattcctaagacagtggtactgtgtaccgatgtcttcgacgagtttatggagaccaataatctttatcaaatcgctctatcggatgccgacgatgatacgattctacgatatttcctaaaggcgaaactgcccgaccggttggtagaggacttcttcaccttctttgatgtggtgaagtccccgattgccatccgttcatcttctttgttagaagattctcattatcagccgtttgccggaatatacaatacgtatatgattccttatttggacgaccgttacgaaatgctccgtatgctttccgatgcgatcaaaggagtctatgcgtctgtttacttcagagacagtaaagcctatatgcaggctacatcgaacgtgatcgaccaggaaaagatggcagtcatcttgcaggaagttgtgggaaatcaatacggagaccgttactacccgtctatgtccggcgtggcacgttcgctcaattattatcccttgggagatgaaaaagccgaagaaggcacggtgaacctggctcttggattaggaaaatatattgtagacggaggtatgacgcttcgtttctctccttatcacccgaatcaagtgttgcaaaccagtgaaatggaaatagccctgaaagaaacacagacccgtttctacgcattggacttgaaaaacgcagggcatgatttctctatcgacgacggctttaacctgttgaaacttcatgtgaaggaagccgaaagtgacggttcgttacgctatatcgcttctacttacgatccgtatgatcaggtgatccgtgacggtttgtatcccggtggacgcaaggtaatcacgtttgccaatatccttcaacacgatgtattcccgctggcacgcatcctgcaactggttttgaagtacggtgaacaggaaatgcggcgcccggtggagattgagtttgccgcgaccttgagccgtgaacaagataagacgggtacattctacctgttgcaaatccgcccgattgtggacagcaaagaaatgctggacgaagacttgacgctgataccggatgaagacgtggtgctccgttccaataactcattggggcatggcgtcatgaacgaaatttatgatatcgtctacgtcaagacggatggatacagtgcttcgaacaatcaggccattgcctgggaaatagagaagatgaacctgcaattcctcaatgcaggaaggaattatgtacttgtaggtccgggacgttggggcagcagtgacacatggctgggcattccggtgaagtggccgcatatctccgccgcccgtgtgatagtggaggccggactgaccaattatcgtgtagacccgagtcagggaactcacttcttccagaacctcacttcgttcggcgtaggctattttacgatcaatgcctttatgaatgacggagtctacaatcaggatttcctcaacgcccaacctgcggtggaagaaacgaaattcctgcgtcatgtccgctttgaaaagccgatggtagtcaagatggatggtaagaagaagctcggtgttgttctgatgccggggattgactgatctctttccggttgataaataaataaaacaaaaaagttctgctctcattggaaaagcagaactttttttaaatagttccgttggttttaaaccaacggggcattccttttaaaggaataaaaaaggatttttattctgctgatatacatctgtttactgttctgtcgaaaaaaagagcataaatccgtcgggaaatatgctctttcttttacaaatggttggttgttcttttattctttcaatgcttcttgcagatcaatgcccaatgctttggcgactccggcaccgtatgcggggtctgctttgtagcagttgcgggtgtgacgctgtttgatgaataattcggagtctcccatagcacgtgccgtgttttcaaacagaagttgctgctcgtctgccggcatcagtcggaacagatcgcccggctggctgtagtaatcatcatcgtattcgcgttcattataattgtatatctctccgttgccggatgctttgagaggcggttctttcatgtgaggagagtctttccattctccgtagctgttgggttcgtagcctttggttgcaccgtagttgccgtctacacgcatggctccgtcacggtggtaagcatggaacgggcaacggggtttattcaccggaatctgttcggagttcactccgagacgataacgctgtgcatcgccgtaagagaacagacgtccctgtaacatcttgtccggtgagaatccgatgccgtctacggtattgatcgggttgaaagcagcttgttctacttctgcgaaatagttttccggattacggttcagttcaaggattccgacgtcttgtagcgggaagtctttgtgcggccatactttggtcaggtcgaacgggttgatgcggtaatggtctgcttcctcttccgtcattaactgaatctggaataaccatttcgggtaatctcccttttcgatgctttcaaaaaggtcgcgttgatgagattcgcggtctttggcgatgatcgcttccgcttcctgatctgacaggtttttgattccctgcaaggtgcgcaggtggaatttcacccagatacgctggttgtccgcattgataaaactataggtgtggcttccgaatccgtgcatgtggcgataggagtaggggatgccgcgagggctcatagtgattgtcacctgatgaagcgcttcgggcagaagtgtccagaagtcccagttactgttaggactgcgcatattcgttttcgggtcgcgcttgatggcatgattcaaatccggaaatttaagcggatcgcgtaagaaaaagacaggagtgttgtttccgactaaatcccagttgccctcttcggtgtagaatttcatggcaaaaccgcggatatcacgttcggcatctgccgccccacgttctccggctacggtagagaaacggacgaaacattcagtttgctttccgacttcgctgaaaatagctgcacgggtgtacttcgtaatgtcatgagtgacggtgaatgtgccgtaagctcccgaacctttagcatgcatacgtctttccggaatcacttcacgatcaaaatgagcaagcttttcaataagccatgggtcttgtaacatgacaggtccgcgttgacctgcggtttgcgaattctgattgtcggcaatgggacgaccgttcgcggcagttagttttttttcttccataaaatagatgttagtcggaggcgaagtttaaataaaccgaagtcttttttattcttctgtccgggtttataatatgtaacaaagatagaccgattttgcttgcttgtcaaactgataatttctatctaaagatagagaataactatgaacaatctttaaaacctccggtattttttatttcaagtacatctttcacccgggtcatgtacttcttttacctttttcttctacatcatttgccagaatgaagtacttcctgtcactcactcttttacatgtttgcctgcactcttttacttgtttttcaccactgcggtacaatataaaaaaaactcccgtccttcctttcggaaggcgggagcctttatcttaaaaatgactatagctttcttatatcttgctgattatacgataccctgagccatcatagctttggcaaccttcatgaatccggctacgttagcacctttcacatagtttacatatccgtcggcttcagtaccatactgaacgcaggcttcgtggatattcttcatgatgctcttcaacttttcgtctacttcttcagcgctccagctcaacttgatggagttctgagtcatttcaagacctgatactgatacaccacctgcattagctgctttacccggagcgtacagaatcttagcgtcctggaatactttgatagcttctggagtagaaggcatgtttgctccctcagatacagctatacagccgtttgctaccaactgacgggcgtggtcgccgttcaattcgttctgagtggcagaaggcagtgcgatatcgcatttttcaccccaaggcttagctccttctacatatttgcaaccatatttctctgcgtattcgcggatacgaccacggtacaggttcttcagttccatgatgtaatccagcttttcgcggtcgataccgtccggatcgtagatgtaaccgtcagagtcggagcaagtaactactttaccacccagttcgattactttttcgattgtatattgagctacgttacccgaaccggaaacaagacaaactttacctttcaggtcagtacctttggttttcagcatttccatcaggaagtagatgttaccgtaaccggtagcttccggacgaatcagtgaaccaccgaattcgcggcctttaccagtgaatgtgccggtaaattcgtgagccagcttcttgtacataccgaacatgaaacctacttcgcggccacctacaccgatatcacctgcaggtacgtcagtttcgggaccgatgtgacgccacagttccagcatgaatgcctgtacgaaacgcattacttcagcgtttgacttaccacgtggagagaagtcggaaccacccttaccaccacccataggcagcgtagtcagtgagtttttgaatgtctgctcaaaggcaaggaatttcaggatggaaaggtttacagatgcgtggaaacggataccgcctttgtacgggccgatagcgttgttgtgctgaacacggtaacccatgtttgtctgaatattacctttgtcgtccatccaagttacacggaactgaaatactctatcaggaatacacaagcgttcgattaagtttgctttgtcaaactccgggtgtttgttgtattcttcttcaatagtagaaagtacttcttctactgcctgatgatactccggttcattggggaaccgtcttttcagatcgtctaatacctttgctgcattcataatctttttttcttttattggttgattaaatttcgattacctatttcttttatgcggttgcaaaagtaaagataaaaattgaactagcaaacattttataaagaaaaatgcaataaaacatcaaatttgatattttattgcattaaaactcagaaaaaagatatttatttattctttttcatcgacttatagacaggaataaagactaacgctgccgaaatgataagcattactatcgtcataccgtcaatacgttcggcttttgtgagaactaaatagcaaagcgccagccaaagcaggctgacgcaaactatttgtgattttgataacggtcttctcatcggctttcgtttttcttcttcactacgatggcgtcgatcacggctacggctgtgatgttcacgatgtcgcggacagaactttcaaagtcagtgaaatggataggcttgttcagtcccatctggatagggccgatgaattccgtatcggggtccattgcctgcagcagtttgtatcctgcgttggcggagctcaggttcgggaagatcagcgtattcacgtctttacctttcaggcgggtgaacggatacttggcgtcacgcagttcgcggttcatggcaaagttcacctgcatttcaccatcgatggcgagttccggatattccttctgcatatagttcactgctccgtgcactttgacagggctgccggaggtatcggcaccgaagttggagtacgacagcatcgagatgaccggtgtatggttgaagaaacggactgtcttgtcagccagtttggcgatgtcaatcagagtttccgtatccggatgacggttgatcagcgtatctgccaggaagtaagtacccttcttcgaattaagaatgtgcattgttccgaaatggttgaatccgggctggatgccgatcacttctttggcaactttgatggtgttgctgtatctggtatagagtccggtgataaatgcgtctgcatctccggtttctaccatcatcataccgaagtagttgcgttcgaacatcttgtcgttggcttcttcgtatgtaaagccttcgcgggcacgtttttcggcaaggatgcgtgagtagcgttcgcggcgttccgactcgtccggatggcggagattgacgatttcgatgccttccaggctcaggtcgagttcttcggccagtttgccgattgcttcgtcgtttcctaataagataggatggcagatgccttcggcttttgcttcgacggcggctttcagcatgttgggatggatgccttcggcgaatacgacacgttgcgggttgcggcgggcggtgtcataaagctggcgggtcagtttggattcgtatcccatcagttcgcgcagatgaacgcagtaagcgtcccagtctttgatttccgtgcgtgccactccgctttccatggctgctttggctacggcacaggaaacttcagtgatgaggcgcgggtctaccggtttcgggatgaagtattccggaccgaaagagaggttgttgacgtggtatgctgtgttcactacatcaggtacaggctgttttgccagattggcgatagcgtgtactgctgcgattttcatttcttcgttgatcgctttggcctgtgtatcgagtgcgccgcggaagatgtacgggaagccgattacgttgttgatctggttcggatagtcggaacgtccggttgccatcagtacgtcggggcgggcgctcattgcatcttcgtaagagatttccggtgtcgggtttgccagtgcgaatacgatcggcatgggagccatgctgcgcaccatgtcctgactcagtacgttacctttggacaagccgaggaatacatcggcgcctttgatcgcttcttccagtgtgtggatatccgtgcggtcggtggcaaaatatctcttctgttcgttgaggtcggtacgtgtcttgctgataacgcctttgctgtccagcatgacgatattttcgaggcgtgcccccagtgatacatataatttggtacaggatacggcagatgctccggcaccgtttacgacgattttcacatcctctattttctttccggccacttgcagggcatttaccagtccggcgctggagatgatagcggttccgtgctggtcgtcgtgcatcacagggatgtcaagttcttctttcagacggcgttcgatttcgaaacattcgggagctttgatgtcttccagattgataccgccgaaagtaggagcgattgcttttacggcagcgatgaatttctccgggtctttttcgtccacttcgatatcgaacacgtcgattcctgcgtagattttgaaaagcagacctttgccttccatcaccggtttgccgctcagtgcgcctatgtcacccagtccgagtacggctgtaccgttagaaataacagctaccaggttgcctttggctgtgtatttgtaagcgtcctgcggattcttctctatttcgaggcaaggctctgccacgccgggagagtatgcaagtgataaatcagtttgtgtactgtaaggtttggtaggaactacctcgatcttaccgggtttgccctgtgaatggtagagcaaagcggcttctttggttattttagccatggtattggtatttttattaataagttatcatttggctgcaaatgtaggaataaaagttatacattgttgtctttagatgataatttctattaattttatagcaaaatgactgattttgcacaaacttatggttgctatccgggtctctgtactccttaatgtataatggttatttcttttttctgattgctatataacatatctgttttgatattctctaggcgacattccttcatgccgtttgaaatatcttcctaaatacgactggtccgggaaaccgagccggtcggctatatcctgcattgtcagctccgtagactggagcagtactttgatctctagaatggcgaaatcatcaatgatctttttggcagaatctccggtcacactgcggcagatgcctgtcaggtatttggtcgaaatacaaagctcgttggcgtagaagttaacttcccgttgtgaaatgcagttttcgtgcaccaatgcgacaaacttcttgaagatttcgtcctgccggcttcccccttctatttcctgtttgtcgaagtagcggtagcatttatcgtaaatatccagcatgaaggattggagatgattcttggctatctggttgcggaagcggttctcgcggtcattataaatagcagttgccgcctgtatcaatccgttgattgctccggtatccttatcgggaagcacatagcacggtctttccttcataaagcggaaaaaggtcggttctaaccgcaggcaggcttcccgaaacatatctttgggaaatccgaaaaaggaagctgtgaagtcactgctgcttccgttgatgcggataatgcttcccggcagcagtaccacctgagtgtttttgacgatttcgtactctttcagatcgatggtgacgtgtgcccatccgctgcggcagaaatagatggcacccccttccattttccagaggtgatgcatgataggtgacaaattctcatcgcttccggcaacaaatgattcccggagaacggcaagggtagagtttctctgtatcataactattcttatttagtgggtaaaaataggactttttcactaaatatcgctcatattgttccgaaaatgaacaaaactctaaacactatgaccagttttctatggtgaaaagagtctacctttgccgcgatcaaaaattttaataggtaacacaatgagtaaaaaggtatgtaaaatgaagcaagggctattattgctctgttgtctggttgctgctgcaggttgtaagcaagctccacccacacaaatggaaacaggatatgaagtaatgaccgtctctccgaccgaccggatgatttcgagtgcctattcggcaactatccgcggacgtcaggacatcgatatttatccacaggtaggcggtacgctgacaaaagtcagtgtcaccgaaggacagcgggtgaagagcggacagacgctgttcatcatcgaccaagtgccgtatgaggcagccctgcagacggcagtggcgaatgtggagtcagccaaagcgtctctggcgacggcacagctgacttacgacagcaaagaggaactgtataaggagaatgtagtttccgctttcgatctgagtacggcaaaaaattctcttctggctgccaaagcgcaactggcgcaggccaaggcacaagaagtgagcgcccgtaataacctttcttatacggtagtgaagagtccggcagacggagtggtaggtacattgccttatcgcgtaggtgcgttggtaagttccagtatccccgaaccgctgaccaccgtttccgacaattcggatatgtacgtctacttctcgatgacggaaaaccagttgctgggactgattcgccagtatggttctaaagacgaggcgctgaaaagtatgcccgccatcgacttgcagctgaacgataaatcggcttatcccgagcagggacagatcgagtctatcagcggagtcattgaccgttcgacgggtactgtcagcctgcgtgccgttttccctaataaggacggactgctgcacagcggcggtgcgggtaacgtagtgattccggtacagaaaacgggagctttggtgatcccgcagggagctacgttcgaaatacaggataagagatatgtatataaggtagtagacggcaaagcgcagtccagtcaggtgcaggtgacccgtgtgaacggtggccgcgaatttatcgtggatgaaggactggctccgggcgatgtgattgtggcggaaggcgtaggattgcttcgtgaaggtactccgattaaggcaaagactgcccaggcatctacgacaactactgaaaattaaacaaaggaggaatcatccatgaatttaagaacctttattgaacgccccgtattatcggcagtcatctctattacgattgtcgttgtgggtatcatcgggctgttcagtctgcccgtcgaacaatatcccgatattgctccgccaaccattatggtgagtaccacctattatggcgccagtgcggaaactttgcagaagagtgtgattgctcctttggaagaagcgatcaatggtgtggaagacatgacttacatgacttctaccgccaccaatgccggtacagtgagtatcaccgtgtacttcaagcagggaacagacccggacatggcagcggtcaacgtacagaaccgcgtgtcgagagcgacgggacagcttccggcagaagtaacgcaggtcggtgtgactacttccaaacgtcagacgagtatcctgcagatgttctcgctctccagtccggacgatagctacgatgaaaacttcctctccaactatatcagtatcaatatcaaaccgcagattcttcgtatctcgggggtaggtgacctgatgattatgggaggtgaatatagtatgcgtgtatggatgaagccggacgtgatggctcagtacaaactgattccgtcggacatcaccggtgtgctagccgagcagaatatcgaatcggctaccggttcattcggtgaaaactcgaacgaaacctatcagtatacaatgaaatataaaggacgtctgatcactccggaagaatttggagatattgtcattcgttctacggacaatggtgaggtcctgaagttgaaagacatcgccgaggtacagttgggacaggatagctatgcttatcacggtggaatggacggtcatccgggcgtttcgtgtatggtgttccagacggcaggttccaatgcgaccgaagtcaatcagaatattgatgaactacttgaagaagtccgcaaagaccttccgaaaggagtggaactgacgcagatcatgagttcgaacgacttcctgttcgcttctatccatgaggtggtgaagacgttgatcgaggcgattatcttggttatccttgtagtatatgtgttcttgcaggacttccgttctacgctgattcctttggtgggagtcattgtttcgctcatcggtacgtttgctttcatggcgctggcaggattcagtatcaatctgctcacgctgtttgcgctcgtgctcgtcatcggtacggtggtggacgacgccattattgtcgtcgaggcggtgcaggcacgcttcgacgtggggtacaggtcgtcctatatggcaagtatcgatgcaatgaaaggtatcagtaatgctgttatcacctcttcgctggtgtttatggcagtatttattccggtatccttcatgggcggtacttccggtacgttctatacccagtttggtctgacgatggcggttgccgttggtatttccgctgttaatgcgttgacgctgagtccggcattgtgtgcgttgctgttgaaaccttatatcaatgaagacggtacgcagaagaataactttgcggcacgtttccgtaaagcgttcaattcggctttcgatattctgatagagaaatacaagaatgtggtgctgatctttatcaaacgcagatggctggcatggtcgctgctcgtttgctccgtagtgttgcttgtattcctgatgaacacgacaaagaccagtctggtgccggacgaagaccagggtgtggtattcgtcaatgtaagtacggcggccggtagttcgctgactacgaccgacgaagtgatggaacgcatcgaaaagcgtctgatggatattccgcagattaagcacgtgcagaaagtggccggctacggattgctggcagggcagggaagctcgttcggtatgttgattctgaagctgaaaccgtgggacgaacgtccgaatgacgaggataatgtacaggcagtcatcggtcaggtgtacggtcgtacggccgatatcaaggatgccagtgtcttcgctatttcgccgggtatgattccgggttacggtatgggtaatgcgctggaactccatatgcaggataagatgggcggtgatatcaacgaattctttaccactacccagcaatatctgggagcattgaaccagcgtccggaaattgcgatggcatattctacgttcgatgtgcgctatccgcagtggacggtagaggtggatgcagccaagtgtaaacgcgcaggcattacaccggatgcggtattgagcacattgtccggttattatggcggtcagtacgtgtccaacttcaaccgtttctccaaagtatacagagtcatgattcaggcagacccgcaattccgtctggacgaaacctcactggacaatgctttcgtacgtatgtcgaacggagagatggctccgctgagccagttcgtaacgttgacacgcagctatggtgcagagtcgctgagccgtttcaatatgtacaattccatcgccgtgaatgcgatgccggcagacggatatagtacgggagacgccatcaaggccgtacaggaaacagccgtacagtctcttcccaagggatatggctatgattacggaggcatcacccgtgaggaaaatcagcaaagcggtacgactatgatcatctttggtatctgcttcctgatgatttatctgattctgagtgcattgtacgagagctttatcattccgttcgccgtgcttctgagtgtgccttgcggattgatgggaagtttcctcttcgcatggatgttcggactggagaataacatttacttgcagacaggtttgattatgttgatcggtctgttggcaaagacagccatcctgttgaccgaatacgctgccgaacgccgtaaggcaggcatgggactgatcgcttctgcggtaagtgcagccaaagcccgtctgcgtccgattctgatgacagcgttgacgatgatcttcggtctgttcccattgatgttgtccagcggtgtaggagccaatggtaaccgttcgctgggtacgggtgtagtcggtggtatgacgatcggtacgctggcattacttttcatcgtgcctactttgtttatcgctttccagtggttgcaggaacgcttacgccctgtgcagagcagacctacggaagactggcagatcgaggaagaaatcaaggtgagtgaagaagaaaaatctaaagcaggaaaaaaataattgatgatgaagaaaatattaatcttatccgcagcaacgctcgtgttgagcagttgcggtatctacaataaatacaaacctgtatcggaagtccccgaaggactttatggaagcgagaccgtcgcttccgccgatacggcgaacttcggtaatctctcgtggagagaggtctttactgactcgtatttgcagaatttgatcgattcggctttggtacggaatacggatatgcagacagcgcatctccgtgtgaaagaagcggaggcttcgttgctgacgtccaagctttcttatctgccctctttgtttctcgcaccggaaggagctgtgagcagcttcgaccgtggcaaagcgacacagacctactcattgccggtgactgcctcgtgggaactggatatcttcggaaaggtgaccacggccaaacgtcgggcaaaagcggcctatgagcagagcaaggagtatgaacaggcggtgaagacacagttggtgtctgccgtggcaaatacttattataccttgctgatgctcgacgctcaatatgagatttccgtgtccaccgaagcggcatggaaagagagcgtgcggacagcccgtgccatgaaaaaggccggtatgatgaccgaagccggactagctcagacggaagccacctattataatatatgtacggcagtgctcgacctgaaagaacaaatcaatcagacggagaactcaatggctttgttgctggcggaaacacctcacaagatacaacgcggcaaactggaaaaccagcagttgccggaagacttctccgtagggattcctttgcagatgctttccaaccgtccggatgtacgtagcgcggagttctctttagcgcaggcattctatacgacgaatgctgcccgtgctgctttctatccttccatcacgctgagcgggagtgccggatggacaaacagtgccggtagcatgattatcaatccgggcaaattcgttgcttctgccgtagcttcactgacgcaacctttatttaacaagggagtgaatatcgcccagctgaaaatagcgaaggcacagcaggaagaagcccgcctcagctttgaacagacattgctgaacgcaggtgtggaagtaaacgaggcactggtgcaatatcagacggcccgtgagaaatccgctttctacgataagcagatcacctctttgcagactgctgccagaagcactagtctgttgatggaacatagtaataatactacttatctggaagtactgaccgcacagcagacattgctgaacgccagactttcacaggtagccaatcgctttaccgaaatccagggcgtgattacactgtatcaggctttgggcggaggccggatgtaggaggatagtatgaatcctgaaaaagtacggtgtcagataatcgaatacaccaaacacgagatgtatctgcacggtgctgacggactgaccatggatgacatagccaaggggatgaagatgtcgaagcgtacgctttacaagctgttccccagtaagacttgtctgttccgcatctgtctttctgatttcaccaacgggatcagaagttgtctgaaacaaagtcagatgcggatggacagttcgtgtatgcaggtgctttttgccacagtgaacgggtatctcacgctattgcattcgttaggaaagactttattgctggatatcgccgcgaatgaagattaccgtgcttccttcaaacgggaagaggccttctggttgcagcagtttatcgatgtactgacgcattgcaaaatctgtggttacctgcttccgggagtcgatccggatcgctttgcggcagatttgcaggaggttatttatcagagttgcctgcaaggtactccgtatgttgttcagcggacgctgaaccatactctcttacgagggctttttgaggtggacggcattcggtatattgacgaacacctgaaactggataaattcaatgtttgtgtatgaaaggaagggcgtgtattgctttttaagcaggcacgcctttttatttgtttgaaatgagttattctctgaaattcacaatcatgtgatatattaagttgctttttaaatcttgtcaattaaatccggagataagcagaaaggcagttaactgttggcaggttagtataaacgcttttattctcaccacaatgagaacattttctcatcgcattgagaaataattctcaaaggcacgagaactttttctcactgtggtgagaattttttctcaaaggcatgagaatactttgagaatatagcaacttgtatcatgctatgtattaatcggatagcagtatagtggtatctgtcttatgcctactattttatggctgcctcaaacgctcaatctctaataatgtagtttcccgcttgtttggtaaaagcggctgggctattctttgtctccatatgaaaacttgacaaatgatcaatctaaagccctttcaccacatcgacagacaaacccgtgcattctgctatcacatcatccgctatacctttctgcttgaaattacgggctatctctatggtttggttgtgctctttgagtgcggagaacaccagaccggaaagatattcaagtgtactgtacaagcgttcccgattttccttccgctgataatccacactaaaaaatgtggaacgcttacggtgtaatatcaggtaatatgtcccggcagtaagaagtcccgctattatatcaattgggatacccgttccttcaaacaaatgcttgtattcttctatagccaatttgtaatgcttttccctgcttcgtgccatacgtcttgtggtcgaattgtccgcttcgagttcccacactagcaagtgctgcatatcggtattgtcatataagtaatttgccaaagcctttaaggtgcttttcatgatgtcctcgttggctttgtctgtagggtgttcttcatcgaaaagatcgtgcagccaataatcagaaatgtaagcgtacttatccagcaatcgctcaatattcttatagttattgagcaggacggacatttgtatgtcggctctttgcataatatctgtaaaggtaatttgcgccagacctttttcacttgctaactgccggatggcatcaaacacgtccgcttccagttcggcgcgggtacggcgtgcacgtttattcttcgattgttccatgtttatttctttgttgcatacaaatgtatgaaaaataagtataagtcacttattttcctttataaaacagatttatgaaacggctcggtcactgaacaaatttatttctatctttgtcttcttagtatttagagaatagaaaaacaaagaacactggagaaagcagagtgggtaagggaacggctttctccatgaacgtatctttgagtattatttaaatcagtagaaaatggggaatttaatttcgtttatgaaggaagtagccgatgctgcaatacgtaaacttcattaacgacaagcccattggcagaattaagtatgcactaaattaattccgccaacaggtagatattaataagtgcttatcgtttgtttaggtgtaaattgcctataaaattctttaatttggctacaaatataattataatagttaaatagaaaaaacaaaaagtctcattttttataccaaatttcctcaaatgtctttttattgcataattaacaaaatattaataaacaaatagatatatcccatataaaccgtcaaaaataagaccatcttactttccatttgacattcttattagttgcttatgcaatagtcattaaaacgacataagacacctcattttgaggattcagagtcaaaagggcaaaaatccaaaactatttcctatttttgtacccactatatataaaaaggtacaagatgaactacggattcgtaaaagtagctgcagccgtgccacacgttaaagtggccgactgtaaattcaatgtagagagaatagaaagccaaatcgcaatagctgaaggtaagggtgtgcaaatcatagtattcccagaaatgagtattaccggatatacttgcggtgacttattcggacagcagattttgctggaagaagcagagatggggctaatgcagatactcaataatacccgccaactggacatcatctctattgtcggcatgccggtagtagtcaattcaaccgtgatcaatgccgccgtagtgattcaaaaaggaaaagtactaggtgttgctgccaaaacttacctccccaattataaggagttctacgaacagcgctggtttacttctgcccttcaactgacagaagataccgtacgcctatgcggacaaatcgttcccataggtgccaacctgctgtttgaaacttccgatacgacttttgggatcgaaatttgcgaagacctttgggctaccatacctcccagttcctcattggctttacaaggagcagaaattattttcaatatgtctgccgataatgaaggaatcggaaagcatcattatctttgttctcttatcagtcaacaatcagcacgttgcattgcaggatacgtattttcttcctgtggtttcggggagtccactacggatgtagtatttgcgggaaacggattgatttacgaaaacggctcattactggcacgtagcaaacgtttctgcatggaggagcaactgatcattagcgaaatcgatgtggaacgcatacgggcagaacgtagaatcaacaccacttttgctgccagccagggaaatccaggagataaaaaagcaatctccgtcgcaacggagtttattaatagcaaagagcttactttgacccgagacttcaattcacatccttttgtcccccaaggagcagaactggatgagcattgtgaagaagtattctctatccaaatagccggcttggcacaacgactggttcataccaaagctaaaacagctgtagtcggtatttccggcggattggattcaacactggcattattagtctgcgtgaagaccttcgacaaactcggtttaccccgcaaagatattctgggagttacaatgccaggctttggaacgactgaccgtacttataacaatgccattgatttaatgaaatcattgggcatttctatccgggaaatcagtattcaagatgcctgtatccagcatttcaaagatatcgatcatgatatcaatgtacatgatgtcacctatgagaactctcaggcacgcgaacgcacacagatattaatggatatcgctaaccaaacttggggaatggtagtgggtacgggtgacttgtcagaacttgcactcggatgggctacgtacaatggagatcacatgtctatgtacggtgtcaatggaagtattcccaaaacacttgtgaagtatctagtgcaatgggtagcggaaaatgatatggatgaggacgctaaagcgactttactggatattgtagatactcctatcagtcccgaattaattccagctgacgaaaacggggaaatcaaacagaagaccgaagacttggtagggccttatgaactgcatgactttttcctctattacttcctgcgttttggtttccgtccttccaagatttactatctggctaatatagctttcaaggatgtatatgacaaagaaacaataaagaaatggctatctactttcttccgacgtttctttaatcagcagttcaagcgctcctgtctgcccgatggtccgaaggtaggtagtatttccatcagtcccagaggtgactggcgaatgccaagtgatgcaagttcaactatctggcttaaagaaatagaagatttataatctctttgatctttcttctgtgacatttttgtatttatcttaagtattatacggggtaaaacagaaatgtcacataactgtgtatcaatcatacagaacatacggtcaattgcactattgtaatacttctcttttaatacgttctatatcagccttctcaatagtgcgaatgatatttttataaatacgatgaaaaccgaaacctccttcggtcatttcctgaatagctttttgctttgacactccttgaaatacaatacgatacatagcacatactgcgcctgtcctatcagaaccgtgatgacaatgaaagacgattggccctttgcggttcttgataatgcgcaatgcattgatcaattgatcttcactgactgaatgcgctttcatttttagccgataaagcttaatctttgttcctgccgcctcatcatcgtcactatgcctgttgcgaagattcagcacttcacgaataccgtatttctccaaagccttaaagtcagcatccgatggttgctccgaacgatatacacctgagtctatctgatacaaattagtcagtttactatcgggaacagttatcttttcagcgtttatgttttgaccataaaccgaaaaagacatcactatcccgataaataaaccaagccaaattcgtttgttattgattatcatatagcaatcctatgagattatataatatgatgaggtaaattatagtactcctttgctcgaaggaagctcaaaatgatagatatctcttttcaatgccattttcagggcacgtgcaagcgctttaaagataccttctatcttgtgatgctcattctgtccttcagccttgatgttcagattcatttttgcagcatcactcaatgatttaaagaaatgcaggaacatctccgtcggcatctcccctattttttcacgattgaactctgcatcccatactaaccaaggacgacctccgaaatcaaggcaaacctgacaaaggcaatcatccataggcaaagcataaccataacgttcgattccgcgcttactgcccaaagcctgataaatacattctcccaaagcgatggcagtatcctcaatggtgtgatgttcatccacttccaggtcgccttttacccgaatggtcagatccattccggaatgcttgcctatttgttcaagcatatgatcgaagaagccaagaccggtagaaatatcacagcctccatttccatcaagattgagagacacataaatatcagtctccttcgttgtacggcgaacttctgctttccgctcaccggcaaaaagaaactctgccacctgatcccagtctgttgttgcaagtgcacaaacttcttccagacctttctctttcaaatcatctgttgcttcttgcagataaatagcacggcaaccaagattctttgccagctccacatcagtaggacgatcaccgattacaaagctttccgcaagatcatattccggattatcaatatacttcgtcaacattcctgtacgcggtttgcgagtcggcgcattatcttccggaaaactacggtcgatcagaatatcatcaaaggtaatgccttctccggccaatgttttcagcatcaagttgtgagcaggccagaaagtgtcttccggaaacgaagatgtacccagcccgtcctgattggtaaccatcacaaattcaaaatcaagcttgctacggataaagcccaaattacggaagactctcggataaaattccagcttttccagtgaatcaagctgataatcaatgggaggttcaatgaccaatgtcccgtccctatctataaacaatattttcttcttcatatactatccttgatattttttgagggcagcaagtaacgtattattctccactctggtacccaccgtcacacgcagacagttgcaacaaagcgaaatggaatgacggttgcgcactatgatcccttcacctaccaaataattgtaaatcttcaccgcatccgttactttcgccaagaagaagttggaatcggacgggtacattcggactgtacaagataatttcgcaaattcttcttccagatagtcgcgttcttccttcaatgtttttatccagcgttctatttcataatatttatgcagcatagcaatagcctgctgctgtgtcagctgattcacattataaggatacttgattttactcaggattccgataattgcttcggatgcaaaagccatacccaaacggatagcagcacatccccaagctttggagaaagtctgaaaaacaaccagattcggatatttatccagctcttcgaggaaagaaggtgcttcggagaaatcattatacgcttcatccaatatgaccaatccttcaaattcgcggagtattttttctatttcagaacgtagcaggtcgtttcccgtcgggttattaggtgaacacaggaaaatgagtttcgtacgctcatctgtagctgcaagaagcttttctgctgagaactggaagttttcgtccaacaaaactttccggtactccacattattcacatcggcacagacctgatacataccgtaagtcggatcgatagcaactacgttatctttttccggttcgcagaatgcacgaaacaccagatcaatcgcctcatcactgccgtttcctaaaaagatatgctggggagaaacctttttaattttagacaacagtgttttcagttcccactgcatggggtccggatagcggttgtgaggcaggttataaggattctcattcgcatccagaaaaacggaagccacagcgcctttatattcatcacgagccgaagaataaggctttagtttccatatattcggccgggtaagttcttgtaatgttttcatttcaatgtatttaatcgtactgtaactgcattcttatgagcatccagaagttcgttggctgccatttcttcaatagccggcccgataactttcatgccttgaggaagaatttcctgaaacgtgattttccggataaagctgtccaggctcacgccgctgtatgctttcgcataaccattagtcggcagcgtatggttggttccggaagcataatcccctgcactttccggcgtcaatgagccaaggaagacggaaccggcatttattacacgttcagcaacttccagataattttcagtctctacaatcagatgttcgggtgcgtatgcattcgtcaactctaacgcttcatccatgtccttcaccaaaatcagtttactgttttccagagatttcgcagcaatttcccgtcgaggaagctttgccagttggcggtttacttcttccattacttctgcctgaagcttttcagaggttgttatcaacatcgcctgactgtccactccgtgttctgcctgcgacagtaaatctgccgcaacaaacaccggattagcagatgcatcagccagcacttccacttcggaaggacctgccggcatgtcgatggctacatcccgaagacttaccaactgcttggcagccgtcacatattgatttccagggccaaagattttgtagactttaggaacactctcggttccatatgccatagcagcgatagcttgcactcctcccgctttgaatatcttactgacacctgccagttgagcggcaaagagaatagccggatgaatatttccgtttttatcgggaggggtacaaagcacaatttccctgcatcccgcaatttttgcgggaacagccaacatcaataccgtagagaaaagcggagccgttccaccgggaatataaagccccaccttttcgatacctaccgccttttgccagcaagttactccttccattgtttctacctttttgccaacgaagcgttgggaagagtggaaagtttcaatattccgtttagccagcgtaatggcagatttcaactcgtcgctgatcagtccttcggctttctgtatttcttcggaagtcacagtgagagcagacaaagtcaccttatcaaaagccgcctcatattccaaaacagctttatcaccttccgctcttaccttatttataatagtacgaactgtatcgaacaagctctccgtattcaaagccggacgcttcagaagttctgcccattgttctttggagggatatttgattagtttcatcattcaaacttattagactatcattttttcaatcggcaacaccaaaataccttcagcacccagtcccttcaatttgccaatgatttcccaaaaacgcttttcatctagtacagtatgaacagagcaccagccttcttgtgccaatggcataatagtagggctcttcataccaggtaacacggcaattatttcttccagtttatccttcggagcattcatcagcacgtatttcttgtcttcggcagtctttactgcattcattcggaacaaaagttcttccagtacttctttcttctcatcgctcatgtttttgttgccaatcaacagcgcttcggatttcatcactacctccacttccttcaagcggttgcttaccaaagtagatcctgaacttacgatatcaaagatagcatctgccagtccaatgcccggagatacttctaccgaaccggtaatgacatgtatctctgcatttactccgttcttcttcaggaagtttctcaaaatgaccggataagaagtagctattttcttcccattgaaccatgacaatcccggatattcaatgtctttcggcattgccaaagacaaacgacatttgctgaatcccaatcgtttgatgatttcagcatcttcctctttttccataaattcattctcaccgacaattcccaaatcagctacaccggtagctactgtttgcgggatatcatcgtcacgaagaaataaaacttcgataggaaaattggaagactgcaccaacaaagtacgcttcgttgtactgattttaatatccgactctcctaaaagtgccattgtctcttcgaagagacgtcctttggcttgtactgcgattcttaacatgattttatttattattttatgatttacaattcgaacaattcagaaataaaaaaaggcttaccgtattcggtaagccttcgttatctttatagagttatacacactatcaatcacgcccaccgagttattcgttaggaaaatgatgatgatgatgtgcaactgtatatttcatatttcttttatttaatgcgacaaaagtaaagcatttgtttgatacttccaaacatttatcacaaaaagttcagtttttatttcaaattaaaggcaatatctcttctggctctacatcacacttatcaaagtgcatttcatctttcgacttttcgtgcgagaacgtaaagtacgtacaaaccgcttcggtacatacttcgccatccttattatataacttagcttcaataattacaatatttcgcttgacttccttaatagaagcacgcaacacaatatgggaatcagtagtactgaccggcttgcggtaacgagtctccatttttgaagttactcccgttgtctgtaatttacgaagtatcacccaagcgcaaatttcatccatgagaacagcctgaataccaccgtgcaaggtattgatccatccctgatattcaggacggggtttccagatacttaccacttcgtcgccatcttcataaaactccatctttattccggcttcattattaggggcgcaaccaaagcaattgtacccttccagacctttccagggatttattattttcttcataatctatgacttctatttaagtttcacttcccaaatataagcaaaatataaaaaagaagaacaattttccacgatttactttcggatgcaacgaatggcgtaagctttgtctaacccggtgtttccctctgctatttcgtttttatcacttctcaacaagaatattttctcatccgcatctgtccctgcttcattcaaagtccaataagaaagatattttccttcataggcagactgaaacttaccggcatacattcctaccggatatccatcaaaacccgtgagattggtagcagttcctactattgcaccggcaccggtacttattgctttccatgtcccggttttcaacaaagaggcatcattactcaaataagttttcagcatattccaatcattccaatcaggcatattccaccccacaggaagcagcttattactgacaattgttccaaaactataaaaataataactcttatctgtttgagacaatagataacctgtcgctccggcattcataatctccagtttcggaatttcttctccatctatatataatgatgttttcagattacttcccatccaatactgcgtaccaattttcactatcgggtaattgtgaatactactcccacgcacatcacgcattatatctttcatggccaatacgggcaacatttcttcaggcatagacaatgctatttgtccgtcaggcaaaatatacaccttacttcgggcagcctgatttccaggagtatatttcaatgaatgttctttcaaatcccacgctacagttccgccgtgcactttatctgcatgtccgaccaattgtactaccgttcccttggataagtcaaccgcatggttatctttcatcggataaacgacaattgcctgtgaagaaaaatcaggcgtcactagatattctttacatatttctgctacctgctgcccagcactcaacactttatacaccttcgaatcgtcaaataccaattttgacacatccacataattgtggaaaacttcggacccggactgccctgtatttccatcttcccaactattgatttctccttcgactttacttatcaaaacatcttcggtcgggatgaaggaaatcgccagctcactctgcttaccactctgcaactgcaatgaagagggcaatgggctggtatatatcttacctccaacatccaatacgatatattgatagcccaaagtggtttcttgcggaataaggatcacttcttttccgctcaaccgatctccctgtatctcccattttccggcaggagtaatgcttttctcattagaaaaagcggaataagtttctttttggaaatcataaatcgccttagtataaaaaccacaaacagaaagttttgggtcagcatccagtataccctgcaattcttcaccttcctttcctaccaaagcgatttttaatttgaaaaatttgtgatcatagtgcagggcgatggctcctttaggagctgattgcagattttgagaagcaaccagaaaatcagagcagaaatagccggcagaaagattttgatctgtttctaccgccaccgacatcgtactttctcccatattcactccctcttcctgataaggataataactgatcaaacgtaatgttacctcatcatcaggataataaatcggctcactggactcaaaaactttttcggaagtacgaaagaaacgcaaattatccgcataacgttcttccttcatggtggaggaccctacaagggcaaatactcccacttcatcattctcttcaaagccattgccagcaacacgtgtatatgtcacttcatgaatatcagcagtaaatttcaatggaatatctccattgctgactgcagccttctctcccggaatatgatttacacatgctaatacaaaaaaagaagaaaaaaggcacacagcgattcctttttccattctaaacaaaatattcatgtcctctttatttaaatataaataataagaaatctttgattgggcagaaagaaggacataagaggaagtattcactttcagttatgagattccacacaacacgtctgttgcgactggagaatcatcaactccaacatttcattctgaaatgccaatagcaaaagtataaatcataaatcaaccaatacttcattttcttaaataatatttatatttattcataagtatcaaattagtagcactttatgaatcagggatatttcaaaaccaaataggcttacacattattatattagtaatctaacattttcaaaaagaatagcctatttctaccccggcaatatgtttaccttttggagactcatactgataacaataaaaaatatctaacgcccatcgtttagccaaagctatctctactccaggccgataacgcatacgatctgctctccaaaaaggagcgtcatccaaactttgataaatttcaattgagaagtagggggaaacgattcctttttcaggtgcataagctaattttaagcgggaacgaaggcgagcttttgaatctccacggtcaaaagtttgctgaaacctttctctcaaagcaattttcaaccactgatattgaaaacttgcagttgctccaaagttataacggtgtctgaatttccattccgaatctcccaaattccggaaatgagtttcatatccggcttccagtttcaaaaatgaataagcccgatactcgcctccaatggccaatcccaaacggtccattctacttacgtcatcctttgtccgaaactccagattgcttaaaagtgaaaatcggggatcgatcttatagttcactttgaatttagtccatgtagtgaaatcatcgctttgcgcaaatacagtggaagtcattccagccaatagcacaaacagcagtattttagtaattgcaaatattctactcatcgattaccgggttaaaagtacaaagataataaatctcccgcaaagaaaaattatgatactgaaataattctgaaatatcaaggctcattcctttaaaagaaacaccccgttggttttaaaggaacaggtcgttggttttaaaccaagagcccgttcctttaaaagaaaaagtacctattttatactccactgataatcaatgatttatttttgcttcgcattccacacccataaagcgaaaaataccgacaatatagccgatccgatccaaaaccaattgatataagtaaagtcgtaaacctctaccccactccggatcgttttatgtccttcaatcaaaactccgctcatgacatcttgcagcccagctccgatataactggcaattccaacaactcccaaagcagctcccgaagcattgcgaggagcaatatcaacagccatcagcccacctaagaaacaaatcagtactccgatgcccagtccaaagaggatcattgccacagcatcgagccaaaagtgtacccctggcactaataagaacaaacataatgctaaaacattcgtcagtccgaaaatcaaagccggaacattacgccggccaccaaacagtttatcagaaattacaccggaaaacatagtgccgataataccacaaacagaactaatggaaataatgaaactggcatccaaagtggaatatcctttctgtgcttccaaataaaaaactccccaactgtttaccgcatatcggctgatatacataaatgcacttgataaagcaaggatccagatagcaggcattgtcagaacctgccgttgagctttattaaaatctgtcgtttcggaagcactcatcgttttcttttctttcggaacattgaccggaggaaagcccttgctttcgggactgtcatgaaaaaaacgccatacaattaatgcccccagcaatcctaccatacccgccccaaagaaaccataacgccagccgcaaacactaacaatagatgctacaattataaatgtcagtgcttcaccaatattatgactggcggaccaaaagccataataagagccacgttctttatccgtgaaccaacgggaaagtccgactacacacgaagcagcccccatagactgaaaccagccgctgactccccaaagaacagcaaacaaaataaatgaatgggagaaaccgagacaaagattaatcaatgcggtaacaagcaggccggtagtcataaaacgatttatattacttcgatctgccagaaatccattcgtaaatttacccaccgcatacgtaaagaacagcaccgaaccgattattccgagttccgtttcagaaaagattccctcgtctacaatcggtttctttactacattcaagctcaaccggcagacataatacataccgtatccgaaagttgccgaaagaaaggtagaccattgcagatatttcaaccgacgcttgccagatgaagacataacgtctccgttacaaggccccggtgaagagaccttgtaaaaatttataagatgtttcagcatgaaggaatatctttagtcgtgcagtttctttttacgcaaatattcgagtaataatgccgggcggtctgtttgaatcagtttagccccctgattcaaaatccatccccagctttcatccggttggtgtagttctaccgcgcgatcgtcatcgtgacctccacaaagttcaggccacaaagaattaatgaaaagcttggcaccactatcacgtactttcctgatcaagcgaagtatttcttcattatcatcattaaataccagttcataagcagtcggtttcatgtgtgactgataatcattgattatcttttccgctccttctttgtgcagattcacaataggcataaaaataaccttatcaagtacatcaccattttctgctttcactcgttcataggggagccctgctttaattacgcaatggtcaattgttcctgttttttcaagtacagcataagcttcctgaaaataatcgtaacctttatcgatattcaccattatcttccctttgcaaagtaacataacttcttcgagagtaggaatctgatgtctggttttacagcctgctccatttttaagtcgcattgctttcagttctgccagtgtataatcctcagcgtttccttttcctgtcattgtacggttaattgtcttatcatgcatgatgaccaagtgaccatctttggtcttcttcaaatctatttctaccatatccactcccatatcaatgcaattccgtattccttgcaatgaattttcgggagcatttcgccaatcggcacgatgagaaacgaccaacactctatcggaataatttcctaacaggttttctctgatttccgcaatccgattttgggcaacagccagttgcaccaggcatacaagcaatataaagttataaattcgtttcataaattcaaatattaaaattattagttcagcttaccgttcttccagaccatcttttctccccacataggcacataggtctggtcacagttaatcttggacgcccgttctagtgccatgtccaatgaccatctggatgcatcaacacctgcatgagccatttccagaatatgggataacagaacataatccggctgtacctgtcccgctccggtacctaaaatattattctcagtcagcgcattaggagcatagcggggaatcaagacattaacatgtggcgcaatgtttgtatattgttccgttttaaaattggaatcaccgacatgcataaagacgaaatttccagtatcgtccccacagtctatctggaaaatagttacgaaatttgataatccggaattattatgatcggtaatacaagtacggattttaaatttacctatttcataatctttatccccctttgccgtgtagggataagtggtgtctttcaaataattggataataccggcttatccaaatcaaacattgcctgaatcaaatctgtattataatgatcagaatgcttatgcgtcacacaaaggaagtcgatatagggtgcaagttccttcgcccagcgatgagaaatatcaatagcaaaacatccggaaggagtcttaactatatatcccatgttataaagcaaccagatttctgctgtgccattctctactttggagttttcaattccgtccatcacccggtcaaaagcactccggtaatagtataagatcggttcactcttctccatactcatacttgcctgatcaaaaccattcagaaaactgataaaatagtcatccagacatttatcggcatatccctgaatagtgctcaaagcatcggcacgttcagtatttacaattgatggagaagttccccataactgttgggtagtggcatctacctctgctgccagttccgtaagaattccttcgtacccggtcttcttatcattattatcatcgtcactacaacttgcaagtcctattgccagcaggcaaaacaggaaatattgtattcttcttatattattcatattatttcagtgttttatagtcatcagttattttatcgaaggtctctgcaatccgttcaagagcaggtctcacattattattttcgtgatccttcgtcgcttcatacatgaaaacgcctttatatccggtcttctccaaatcttgcatcaactttccccattttatatttccctgtgtaggaagccagtggcattcgttcaccaaatcaaaatctgaagcatgtatagtgccgatacggctacctactattgccacaaagtgctctgtcgtgcctttggtatagtgatttgtatcaaagcacacttttacgtccgggatatctccgacaatcctcataagttcctccggagtatttcccaaacaggttctgggcagattctctatacaaagttgagcgccaatcctatcagcatatttcttcaaataagcaatagactccgaagcattggcaatccgttgcgcccgaatactatcggctatcggttccgaacttggatgcaaaaccaggcaagtcggttggaacatggcacacaattctatcatctctgccataaaatctacattttccttccttaaccgatcatccagaactgagatatccagcgttcgggagaaaggaagatgaatagaccagacttcaatatccgcactgtctatcttcgctttcatttcctttatacgtggaatcacttcatcgacaggaactcccctataacattgattaaaggctacttcgacatacttcacaccaatcgcttttgcatgaaggaagtcggcagcagcaggtgctttccacactgctgtcgtagtacctacttcatatttctgtgcatatccacaaacagacatcaccataaatgcgataaatatcaattttctcatcaccgtttatttttgtcggtttgtaccttgaatatctccaccccgtatactccaggagtctgtttccaacgttttattaatgtcaaacgcttttatagaacctatattgctcgctccaatagtaccacaataaagacgcttgtccggaccaatcgaaacggatgccattacctgttgacccacagattcctcataaacagtacttccatctgccgtattaagtccgaaaatcttattatttgactgcgttccgatataaagaacaccatctgtactcaacgcagcaccactgtagttcaggttattatttaccttcttcacccatacttttgaaccgtcagcgtctacagcgtaaactgtttgcgaacctttctctgtaaaataaacaacacctttcttatctacgatagggaaataagcatcaccgcctgttgtcggataggtccattttttggttccgttcgtgatatcaacagcaacaagtccagcctttgacttcaaagttgcgtaaagcgtgttgccattcaaagcaaaagttccctgctctgtcacattaacaccactgagtttccaaagttcttccttatttgcgctgaaagcataaatagcttcactggtacctgcatagatatgtccgtttctatcaatagccaccgcacttcctgttgttccatcaagagattgttgccatttaatcgcaccattcgcaacatcgagtgcatataacgtacttttattagtcaaacaatagagtacaccatcagcagacaaagcagggaacgcacctatcggtccgtctaattgcaatgaccatttctgagtaccattcggatttatggcatacacattcttgatagaagcatctctcacgcactgatagatagtaccgtcagaccccactaatgcaccaccgccataagttattttatcaatggcaaatacccatttgaattcgccgctgactacatctaaggcaaacaaatgcccggcaggcgttgaagtcggaatatacatcgtctttccatccggggagaatacaggattggacgtcttgacatatcctgttaatccgttaaaatttagattcagactatcccatttatattcgacaacattaatttccacacttcctgactccgtcgtattattcgtatatgttactgtaatagtaactgtataagttccagtagcagcaaaagcatgcgatggagtcgtttcagcagaagcagtaccatcaccaaaatcccagctgacggatttaacattgccaccagtaaaatacatatcgttataagcaaagacagcagactcccagacaaccaattccgtattgactgctaccggataaataattcccggagtagccaccgcttccgccgaaacagaattccccatcggataaatgcaaacaacatcaaacttatactcctgatcattagtcaacccttcaaccatatattcttccaatgttgtgtcatccaatttgataacctgattgccgggacttacggtaatctgataattcgtaaaccgttcgctggcaggcttcgtccatctcagccggactttcttgtctcccgctgacgcagtcagaccagtcaccggatatcttgcattctttggcgtacaagaagtagatcgcttactcgccaatcctccggtatagcgaggttgtacggagaatgtataagcaacatcattgacaagatcactgacagttgcaccggaagcctcagcctccacagtcatttgccctccttccgctcccgaagagcccgaagtccagctaataagatattcatcaggacgggcgtccggatatgcttcccaggaaagtgccacattcatatctccggccgttgccgtaagcgtctttaattcatataaatcaaaacttgcttttggcagttcttcgtcacaagctgcacaaactgccgtaatgacaaacaacaagctatatattatttttttcatcgtctgaattctttaagtttaaccatattaataccccggattctgccacaacaactcggtattgttgattctttccaattccgttttaggaataggatacagaaactggaaatcctgaattgtatgtccctccgctttcatagcttccttggcacctcccatgcgaacaaggtcaaaccaacggtgtccctcataaggaaattcctgttggcgttccagcataatggctttacggaaactatcctgatctgccagttccgtaatctgaaccggagataatccggcacgggtatgtaccgcattcaaagcaaccattgcatcagaagtctgagagttgctatagctgatttcgttcagtgcttcggcatacattaacagtacatcggcataacgaagaataatctgatcgttaccgacggtattgtatgtcgcacttttcaaatccttgaatttattcattacgcaaactttatcttctactttcacataagtgatcaggtctttgcgtttatcaccgtctttatagcactccttcaaagcctttgtctggttagtatcatctgtcaggttgataattgaaaaccaataaccatgtccttcaccctcaacgtccttattaaagcgcactgcgaaaatgatttcatcgttcattttattatcgacatcaaatactttatccggtgtaggcatcaaagaatatctgcctatcagttgcgaaagtacattgcgtgcctctgtccacttatggaaagtcagataaatctttcccagcaatgccattgcagcaccggaggtcgcacgtcccgtatcagtacccgtataagaagaaggcagcatattctcattgataacctgattcaaatcgccggtaagaaaatcaaagacctgctgctctgagcttcttccgattttaagagcttcagccaccgtcaccactttatcagtcatcggaattccaccccacaagcgatacatattaaaataagtaagagcacgcacgaaaagcgcttcccctttatattgtttcttcaacgtagcatcaaagtcagctgcgtctattttgtccaataccaaattacagcgatatactccgttattaaaattcgcccaggcggattccaatattccattagaggctttatccgcaaactgatctatatcataacggtcttgtgttccggcagtaggagcactcaacgacaggttgtcactccgatattcgcagcattccgtgaagtaggaaacctgtccctgcaatttagaataacagccgatcactgctacattaaaatcgtctgctgtcttgtatactttatctgtaggcacactgctacttggctccaagtcgaaaaagctatctgtacaggccactgatacaaaagcagttgccaagaataggatttgtctatatattttcatacaccgtatatttttaaggatgactaaagtgttatatttaatccaaacaagaaggttttcgccagcggatatgttccgtaatcttcacccggcgaaagtgaattgctcggacgtgcatttacttccggattgtatccaccgtagttggtagatgtccaaaggttctgtccggagacatagactctcaacttctccacaaagaaacgacgtgtcagattctgaggcaaagtatatcctaacgttacattctgcaatctcaaataagaaccatcttccagatgccaggttgaagtacggccattataacctttcgatttgcggttggcacggttcacctgaccatttccggggttatccgcacttttccagcgattcagggcaatcgtggtaccattggtgtttccttccaaattatcaatatagcgacgattcagattcagaatctcattaccgtaaactccctggaagttaaagtcaagatcaatgcctttataccatactttaccaccaaatccataggtgaagtcgggcatatagttacctactatcgtacggtctttgtccaagtccatcacaccgtctccatccacatctacaaaacggaagtctcccggctgagtattgctgaaatgaggatatttcttcaattcttcttcgttggaaaagataccgtcctgcaccagcaaatagtaacatccgatcggttcgcctacttttgtgatataataagcatgatctacgcttccggtagagataatgggagcatttcccggaccaagagcttttacttcattggtattcgtagcatagttggcattaaaagaatacccaaagtctttggtgaaatttttctgagatgtcaaggctatttcccaaccacggttatttacttttccaatattcatcagggcagtgctgtatccagtcagatgaggaacaggaacattcagcaacatattggaggtattggtattatagtaatcaactgttatccccaataatcctttgaacatttgcaggtccacaccgacattgaccattgcattcttttcccagcttaaatcatcattcttaattgtattgggcttataaccttgtaccagttgcccgttacccgtacccagtatataattatcaagagccatcaatgatagataatcgtagttgcctatctgaaagttacctgtaacaccataactggttctgattttcaagtcatctacaaaggagagaaatttcgccttcgtgaagaaatcctccccgctaactctccatgccaatgatgcggacgggaaatatccccagcggttattttttccgaaacgggaagaaccatccgcacgaatagctccggaagccatatatttacctttataactatattgcacacgagccagataggaagcaatcgaccattgggtcttatcagacgccccctttataactgttccaccggagatcgtctgtatataatcattcggaaaatcggtagccgtcacattatctcctttataagtttctttttgtgcagattgcaccagaaccgcattaatcgaatgatcttcattaatcactgtattataattaatcttattctcaatcagccaattaaaataaaaaccggaggagctgtatgcagtagggttcgacttgatatcataatatttctggcccagtaagggtagttctgacgaacgatactgatcattatgagaaccataataatcaccaccgaaagaaatattataagtaagtcccttgaaaagttccagttcggcaaagactttccctacaattgccatacggtctactacgtccgattgcagattggccattgccacagggtttaataccgcattgtgctgatagtcattgccaattctccaatagccatttccctgatagttataactaccgtcggaattatataccggccacacaggaggcatcatcaaggccgactgaacaataccattcgatccggaagcatccacccgattggaagtcgaataagaaggagaaaaattaagaccgaatttcagtcttttatattttccgtccagattcatacgcatgctatatttcttgaaatcagaattgatgataataccttctttatcataataattggcagaaataaaataaccaacggtctttcctctgccggagatagaaacattatggctggttgtagccgcactacggaaaattgcatcctgccagtctgtgtccgttaatccctgatcgccgttcagataaggaaaaagttctgcaggaatccgttcccatgaattcggacgcataccattagggtcattgggtgaaccaccgggattagcatccagataagaattatcatgcccgtctttggcaaactccgcaaactgataagcattcaacatcggaagtttttttgaaacactctggataccataatatccatcatattgtactttcattttttccgactgcccttgtttggtagtgataataattacaccatttgatccgcgactaccataaatcgcagcagacgaagcatctttaagtacctctaccgactcgacatcattattattcagattggcaaagccacgctccacaggtacaccgtcaatgatatagagaggatcactccccgcattgactgtactgataccacgaacacggatactgacacttccttccgggtcaccgctcggctgagtcacttgcactcccggcatctttccagctaatgcctgacgaaagtcggaagcagaaacctccgcaatctgctcggctttcacggaagagatggaagtagacacatcccgtttccgctgtacaccatatcctaccactactacttcatcgatcatcttgctgtcttcggtcaacgtaatcttagccgtattcttatcttttgcagaaaggctgacggtcttatagccaatataggaaattgtcaatgtagccgattccggtacattcatcaacgaatatcgtccgtccatatcggtaatcgtaccactgccctctcctttgatctggacactggcaccaataactggctctcccttatcatctacgaccactccctgaacggtacgtgtacgttgagcgctttcttctttaagcggctgtttactgacagcaattgtattatcggtcctattgaaataaagttttgactgagtagttatcactcccagaatttgtttaagcgtagcgttttttacatcaaaagaaacatgcggagcgttatttaccgtttcctgatcgtagataaatttaaagttggtctgttcactgattttattgaaaacattttctaccggctcgttttgtacacggagcgtaatgttgttctctttcaatgtctgagcagcagtcggagcaactaaaaggaaggtgaatagtaaaaaagctaaaaacgagcagctatttctactttttcctttacaaataagaagattattcataaatttgtgcgttttagtaattgactaaagttattaaaaacaagcaacgtgcgatacgttattcatttgggtcgaagcgaatgaatatccgtccgggttgcggatagaagcattccttaggagtgcttctatctttttagggagtttctatgagggtgatgctttcattctgtccttattaacgggttaaacattgatctattttttaattctcattttttataaagaagtatattcctgccttctttcttataattgatatcactgataaattcgatggatttaagtacggactccagactcttattgtcatgttcaccggtaatcagattatcaaattcctgtccggaagcaaaggttatctgacaattataaacacgttccagttcttttgccacatcccggatcggagtactgttaaaacgcaggcttcccttgatccagactgctaccccacgttcttccttcttcttactatattcaccggaaacggtatttatcagaacttgttcttttgcagtcaatcgcatcattgcttccggcagatcaacctgtactttgccactctctacacttaccgatacgatttcatccgtagagtaagattttacatcaaaccgggttcccaaaacacgaacatccagtcgcttcgtctgtacaataaacggcatatcttcattatgggcaaccctgaaatatccttctccttccagttccactttccggatatccccttgaaaagaatcaggataacgtacttgtgaacaagagttcaacactaatatagttccgtccggtaattccacccgtttcttctctccaaaagaggttgagatttcagcgaaagttatctgctgctcactcatataccggaaataactgatacttcctgtcacgatggctattacagccgccacactggctgcaatcgtcattacccgacgaaaccaggtacgtttcttatgttcaatatgtttcagcaactggcgagcctcctttttatacttctcacgctccaagtcagtaacaggctgctggctgacggattcctcccagacttcggcagacaactcatccaatatatctttatggtcagcatctctcatactttccagtaactgcgatgcttcctcccggatgtacatatcatccagataacgacgtaatttatttttttctgtcttcgtatctttcatcatatattcaaataagggtgctgatttctccccttcgtattagtaatacacaaaggcaggaaacagctagggtatgattaacatttattataaattcagacaaagtagaatcagcaatatgtcagcagaagtacccgaatatttagtcaagtaggcacgaatcactttcaacgaaacagaaatatgctcctgtacggtattgacagagactcccagcgcttccgcaatttctttatgggacatctgtaaatctcggctcatattaaagacttcacgctgacggggagtcaattgttccaatgcacggctaaggacatccttcaaatcatcgaacaatattttattattcgtttcattggccgaatcaaccgcatgagaaaggatatgctctttcaacttatcttcattcgccatatcccgtatctgattaaggatacgattgcgtacaatcgtatataaataggatgagaaagacgcatccggattgataaaacgcctgctttgccatacaaccgtaaacgcgtcctgaaaaatatcttcggcaaactcacgagatttgacgaacttcatcgcaaaatacagcaagcgattcttataggcggcatagagttcgcaaaaggcatcctcatcgccgtctatcagacggagaactaactcccgttcgtccataagcgtgtctgttgcgtacatattttctttacttttgggcacaaaggtattgttatgatgttacaaacgtatgtattttttctgaaataaaaaaataaccttctttcttattgagtttccggccgagaactttgtgtactctttaattgttgtcctattataaaagtgcgaacaaagcacacaacaaagttctataaaaaagaaaggaagattatgaaaaaagtaatcgacagagcttcatcaagaggctattttaatcatggctggctcaaaacccaccacacattcagttttgctaactattacaatccggaaagaatccatttcggagccttgcgagtgctgaatgatgacagtgtagacccgtcgatgggatttgatactcatccacataaaaatatggaagtaatttccattccgttgaaagggtatctgagacatggcgacagtgtacaaaatacgaaaacgattactcccggtgatatccaagtgatgagtacgggcagtggtatctatcatagtgagtataacgacagcaaggaagaacaattggaattcctgcaaatatgggtattcccccgaatcgagaatacgaaacccgaatataacaatttcgatatacgtccgctgctgaaaccgaacgagttatctctgttcatttcaccgaacggcaagacaccggcctccatcaaacaggatgcctggttctctatgggagacttcgatacggaaagaaccatcgaatattgtatgcatcaggaaggtaacggagcttatctgtttgtgatagaaggagagatcagcgtggccgatgaacatctggccaaacgtgacggcatcggaatatgggataccaaaagcttctctatccgtgctactaaagggaccaaacttctggtaatggaagtacccatgtaaaaaacattatttctagttttattctattctatttaaatgaagcggtcccactctacagagtgagaccgcttctcattgatagttatatcttcggattatttttccttccgataattctccagtccagtttgcaggaattcaatatatttgggaatgtcttcatcgtaagcataagacttattcaaaggacttccctgattatccagcaatacatagaaaggctgtgcattagcaccaaacttcacacgttgcagatagctccacttatcaccgactgtacgcaaagtacgttccttaccgttctctacgattttcacaggttcggtcaacggagttttattatccacatacagagtaatcagcacataatcattattaatcagatcactcactttcgggtccgtccatacagcggcttccatcttacgacagttcacgcatccatagcctgtaaagtcaagcatcactggtttgccattcagacgtgcatactccatacccagatcgtagtcatcgaatttcgcatgtacttcattcttatacagattaaagtcttgcgtatgcataggaggcgcaaaagcacttacggcttttaacggagctccccacaaaccgggaaccatatatacggcaaacgccagagaaataagtgccataaagaaacgagtcactcccaccttattgtcatcatcgtcatgcggaaacttgattttaccaagcaaatagaaacccagcaatgcaaagatgacaatccacagagcgaggaaggtttcacggtcgagtaatctccagccataagccagatcggcaaccgacaggaatttaagcgcaaatgccagttccagaaatcctaacgtcactttgatcacattcatccatccgcccgacttcggcatagacttcagccatgacgggaacagagcaaagagtgtgaacggcaatgccaatgcaatggcaaaacccaacataccgatagccggggccaccacgcttcctgtagtagaaacctgtaccagcaggaatccgataatcggacctgtacaagagaaagataccagtgaaagtgtaaatgccatcaggaagatactcagcagaccggtagtcgattccgctttactatctaccgcattgccccactttgacggtaatctaatctcaaacgctccaaaaaatgaagcggcaaagattaccagcatcaggaagaaaaggatattaaagacagcattcgtcgataaagcattgagcgcactggcaccaaatatcagtgtaatagccaatcctaatgccacataaataacgacaatggaagcaccataagtccacgcatcacgaatacctttcttcttatctttgctacgtttcagaaagaaactgactgtcatcgggataataggccacacacaaggagtgaacaaagccagcaatccacccaggaaacctgtcacgaaaatataaatccaggacatatctccctgagtatgttcctcgcccagtgcctgcaattcactgattaccggacgccaaaggtcaccggaagctactgctggttgaatatcggcatttgcatccgtagcagaagcaggaaccagttccatcatcgcagcagagtctttggacgcagcaggagcagttacctcttccgcctcttttgtctccggcttatcaactttggctacaggagtagccgtagttccggcctttgcttcacccgaaaacttaaaaggaacttctgtcggaggcagacaactctcatcgtcgcaggctccatattccagataaccttctatcgcataagctccaccagtcagcttcactttctgcacgaatttggcagtattctcgaaatagcgcactttcatttcgaacagtttgtcgaaagtagctatttccttgccgacaggcttcaatttaccaaccagttctacaccggacttcttctccacattaaatgtggcagaaataggtcctccgtctccaagatcggtagaataaacatgccaccctttgtcaatggcagctgtaaacacgatctccgcttctgtatcagaaagagagttcagttctgttttaaactttaccggatctttaatctgcgcctgcaatgtataggctacaaagcttaaaagcagaaaagaaattaattttctcattttcattattgggggttataattcataatccacgcatgcacgactgtcctttgcttcagctataatctttccggctgccacatgatcagggtgtgttgcatagaacttcacatcctccagcgtgtcaaattcgctatagagagctatatgccaagcctctcccggattcatattcagtccgacttcaatcttacggatcactgaaatcttagcggggagcgcttcgatagcttccttaaatttattcatcactacgagtttctccgcttcgggaacttcgtcttttaacttaaataatacaatgtgtttcaccattacgttgttattttaatgaattgtttctatatttgtcttgtcaatgcattacattactaatgcaaaattactctatttggttcaaataacactataaagagatgttaataataggaatagcaggtggaacgggctccggaaaaaccaccgtcgtacgaaaaataatagaaagcctccccgttggagaagtagtactattacctcaggattcatactacaaagacagtagtcacgtgccggttgaagaacgtcagaatatcaactttgaccatccggatgcttttgaatggagcttgctttccaaacatgtgatgatgctgaaagaaggaaaaagcatcgagcagccgacctattcttatctgacttgtacccgccaaccggaaaccatccacatcgagcctcgtgaagtcgtcattattgaaggtatccttgccttgtgcgacaagaagctacgcaatatgatggatctaaagatatttgtagatgccgatcccgatgaacgcctgatacgtgtcatccaaagggatgtcatcgaaagaggacggacagcggaagctgtcatggaacgctatacccgtgttctgaaaccgatgcacctgcaattcatagaaccctgcaaacgctatgcggaccttatcgttccagaaggcggcagcaatgcagtagctatcgatatattaacaatgtatatcaagaaacatttgaaaaatgaagaatgaaagataaagagttcagaatgagtgccaagacactgatcctccccttgtttcttatacttttgtgctgtgtattcggatgccggaacaaacatcataccgaaaagaatgaaacagcacacgatcttccacagattaaagacagtggagaactggttgtgctgacactctatagctctacttcatatttcatttatcgcggacaggaaatgggattccaatacgaactcagtgaacagttcgctaaaagtctgggactgaaactcagaatcgaggtagccagaaatgtccgtgaattgattcagaaattacagtcaggcgaaggagatatgatcgcctacaacctgccgattaccaaagaatggaaagacagccttttgtattgcggagaagacataatcacccatcaggttatcgtccagcaaggaaatggaaagcataaaccattgaaagatgtaacggaacttatcggcaaagatatatatgtcaaaccaggcaaatattacgatcgcctcgtgaatctgaacaacgaactgggaggtggtatccatattcataagataacgggagatagcgttaccgcggaagacttaatcacccaggtagcacaaggtaagattccctataccgtagccgataatgatttagccaaactgaataaaacttactatcccaatctgaatatcgatctttctatcagttttgaccagcgttcttcatgggctgtgcgaaaagacagtcccgaactggcagccgccgccacaaactggcataaagaaaacatgacctctcctgcctatacggcaagtatgaagcgttacttcgagaatagtaaaatgatgccacactcccccatcctttcacttaaagaaggaaaaatatcacattacgacgatttattcaagaaatacgcccaagagatcggatgggactggcgaatgctggcatccctcgcctatacagaatcaaactttgacacaacagccgtatcttgggcaggagccaaaggattgatgcaattgatgcctgccactgcacgcgcaatgggcgtacccgcaggtaaagaacaaaacccggaagaaagtataaaagcagccgttaaatacattgccgccacagaccgaagtttcaatatgatccctgacaaacaggaacggctcaacttcatactggcttcttacaatgccggcctaggacatatctacgacgccatggcattagcaaaaaaatacggaaagaataacctcgtatggaaagacaacgtcgaaaacttcatcctgctcaaaagcaatgaggaatacttcaccgatcctgtttgtaaaaatggatatttccgtggcatagaaacgttcaacttcgtacgtgatattcagtcccggttcgaatcgtacaaaaaaaagataaaataagtaataagtaataggtaataggtaataaccgtagcttatcaatagtgtatccgcacggcttattacctattacctattacttattacctatttattacttgtttctgcccgtcaaaaggctaaccacaacaatagccagtatagacaatggtaatgcaaagagaatagggtcaattaccggaaacggataagtctcaatcaatacatccttgccaaacaggaatttacatattcccattgcggcagcttctttctgatgaaggaatattagtgcaaaagcactgcctaaagttcctacccagagacttgccataactccctgtttcgtcgctttcttccagtacaatgcacaaaagtaggcaggaagaaatgcagcagcacagatacccatgaaaatagaagttccgcgggcgataatatcatgtggcagcatatagcaaataatatagctgaccaaaatagagaaaagtactcccaaacgaatcacatttgtcaatttgccacgagaacggggtttataagtaccataaatgtcagaaccaaccgatgctcccattgtgtggaactgagaactaagcgtagacatacttgcagaaaggatacagagcataaacaaagcggcaaaccagtccggcatagctttattgatgaaataaggaatgattttatcaatatcctgtatcacttccgtagcaacggctccttctgtcttcaagaagaaaagattgcttaatgcaccggcatgatagatagctcctaccgttataatcaggaaaaaacaaccgataaatacgccacgattcaactgtttgctactttctaccgtcataaaacgtaccaccaactgaggctgtgcaaggcaaccgattcctactcccaaaataagagaggtaaccaatgagtaccactgcggagaacctgtcacaggcattgcggtccatccctgatgccccaatgccttgaacttttccggaaccagaggggctatatttgtcaattccttgtttgcttccgtaaaacccatgccaagcacctgatacaaagagaacaacaggaacaacatacagccaaacatgataactgcctgtaaagcatccgtatacatcacccccttcattcctcccgcaatcacatacgcagcaatgactaacgtaaatatcagcagagatatattaaaatcaatctgaaaaatctgttcaataaatacagcgccccctttcattaccacagcagcgtacaacggcatacctataaatatgacggctgcaatgaacacctgtatattacgggaacgaaaatgacggcctaataactgcggaaaagtgctgacattcagttttgctcccatgcgccgcgtacgcaagccgaagaatatgaaggcgataactaccccgacaaacatattgaggaaacacagccactgaatacccataccgaaagcagccgctactccgccaaaaccaactatagcagacgcagagataaacgtagcaccataagaaagcgccatcactatcggattcatctgacgtccgccaaccagataatcactggtattcgtagtcttcttatatcctaaaaaaccgaggtaggccaatgacagcagataagctatcacaatcaagccaagagtaaatgtattcatcgcgtttcgtctttatcgtcgtccttattccaatatttcagcccaaaccaggcagcaaaaatcacacatatcactgagaggatatatggcaagactataaaagggtcatctattccaaacatttgcgtatcagattttaatcaattaagccacaaatgtaaggaatttattgaaaagacaaaacttttgtttactaatactgattataatgtatctttttctcgtcatatttctgtttcggctgctcttttgttgcaggatagccgaaaggaatgacacaaagaggaagaatattctcgggcaggtgggtatatttgcgaacgacttccatacgatcttcatacggataagcagctgtccatacagcacccagccccatactttcagcagccagcaaaatattctgtgctgcagcagaacagtctaaataccaataaaaagaacgggcagaatcaccacagacaataatcgcattacgggcttgtgtcaacattttggcataaggaagagccgccgccatcgaatccagtttcgcacggtcggaaacaaccacaaactcccagggacgaacatcctttcccgatggagcagacattccagcacgaagcattaaatcaattttctctttctctacacctttattcaagtaagtacgcacactcttacgctcaaagatattatccaaagcggcatttccggtgccggttgttcctttttcctcttttgaggaagaacacgagatcatagcagtcattgccatgaacatacacaagaaagaaaaaatctttttcattgtgacaagtctttaaaataggtttaacttatttttctgggcttcttccaacgatactgtttcacggcgtaatagtccgctcttctcacgaagtgcctgatattctgcatctaactcattaatcagttcggctttcatctgcgaattcaacagccgggaagcaacactggcattctgagaagcatctttcagatgtacaaccggtgcatgatatacaggtgcgattttcagtgccgtatgcatctttgaagtagtggctccgccaatcaacagaggaatatccagtccggctttctccagttcggcagccacatgagtcatttcttccagagaaggtgtgatcaaaccactcaaaccgatcatatcgactttttcttcgatggcacgctgaacaatggtttctgccggaaccatcactcccaagtcaactatatcataaccgttgcacgccattacgacggcaactatattttttccgatgtcgtgcacatccccttttacggtggcaagcagaacttttccggcagaagatgatccttccactttttctgattcaatgatcggttgcagtatagctacggctttcttcatagtacgggcagtcttcacgacctgaggcaggaacatttttcctgcgccaaaaagctcgccgacataattcattccatccatcaacggaccttcaattacatctacagctttatcatataaaggtaaagcttccgctaaatcctgttccagataatcaccgattcctttcatcaaagcatatttcaaacgctcttgtacggattcttctctccatgcatcctgcttcacagctgcctgaccggaagtaccgcccatcgtttctttcaatgcttccgccagttctatcagacgctcggcagcatcgggacgacgattcaatacaacgtcctctatcttttccagcgtatctgcaggaatatcactgtagagtacggaagttcccggattgacgattcccatatccatcccttgctggatggcatgataaaggaataccgcatgcattgcttcacgaatataattattgccacggaaagagaaagaaagattactcactccgccgctgacgtgtgcaccgggaagattcttcctgatccatccggtagcttctataaagtctacggcgtaattgttatgctcttcgattcctgtagccaccgcaagcacattcgggtcgaaaataatatcatgaggattgaatccaactttatcaaccagcagacgatatgcacgttcgcacacttctatcttgcgggcagcagtatccgcctgtcctttttcatcaaaagccatcacgacagttgccgctccatattgcttgatgatccgggcatgctccagaaatacttcctccccttccttcagagagatcgagtttacgattgatttgccttgcaggcatttcaatccggcttcgatcacttcccatttggaagagtcgatcataacaggtacacgggctatttccggttcggacatgatgagattcagaaaagtagtcatctcagtacgggcatccagcagaccatcatccatattaacgtcaataaccaaagctccgtcttctacttgctgacgagctatggaaagggcttcatcatatttcttttcattaaccagacgaagaaacttgcgtgagcctgctacgttgcaacgctcacctatattcacaaagttgatttccggttttacttccagcagttcgagtccggaaagccacatacaatccggtttgggtgccggaacatgaggtttggcacctgctatcagtgcctgatattccgcaatgtaggcatctgtcgtaccacaacaaccaccgataatattaaccaatccttcctgaatatactccttcacttcatgagccatatctgcgggagtctgatcatatttccccagactattcggaagtcccgcattaggataagcactgatataataaggtgcacgcgaagccaactgttcaagaaaaggcttcaactgacgggcaccaaaggagcaattcaatccgactgaaaatatattggcatgctgcacagaagcaaggaaagcgtccaaagtctgtccggacaatgtacgtccgccgatatcggataccgtcacagacaacataacaggaacttctattcctgtcaccttcatagcctgtccggctgcaaagatggcagctttcgcattcagcgtatcaaatatggtttcgataagaatggcatccaccccaccttccagcatggcttccatttgctgctggtaagaggcagccagttcgtcataagacaaggcacgaaacgccggattgttcacatccggactcatggaacaggttttattggtaggtccaacggagcctgcaacaaaacgcggtttatccggattctttgccgtatattcgtccgccagttcacgtgccagtctggtagcggcaagattgatttcgcgcacatattcttctacatgataatccgccattgagacagttgtagaactgaatgtattggtctcgataatatccgcacctgcttccaggtatttacgatggatatcttgaatgacatcggggcgagtcagacacaacaaatcattattccctttcaactgaccgggaatatgcgcaaaacgttcaccacgaaaatcttcttctttaagattatattgttggatcattgtgcccattgcgccatccagaatcagaatacgctcggatacaatctgagaaattgtctttttcattcttaccttattacattaacacctaattgtcactctgcctatcttagacctatcacgatcttatcttactattacgctataaagccatcttatcgcttaaacattcgggccatgtctctgcggtcatctttttctttaattgattcccgtttatcgtactgttttttacctttcgccaaagcaacgaccagtttcgccaaacctttttcgttgatgaacaaacgcacaggaacggtagtaaaaccggggtctttcattccccgttgaattttctccaattctttcttattaagcaacaactttctgtctctacgagctgtatgattattgtacgaaccatagaagtactcggcgatatgcatattctttacccataattcgcctttcgcaaaataacaaaacgtatccaccagacttgcttttcctaaacgaatggatttaatttccgtgcctgtcaatacgatacctgccgtgtaggtatccatcaactcatagtcaaatgtagcacgtttattcttgatatttacagaaggttgtttcatctttacacattaattaagtatggctatcaacttactaaatacaatttgaatcaccgtcggacatagtattaacaaaactgatgagaaaagggtgtatttcaatcgtactttttcctccacttgcatcaatatgggagctccttcccatactacatagacaatgtagaactgaaatagccaggcaataattctaaaatcaggtaaaagtccggtcacaatctgaagcaagaaggggacaacaagtgcatatccggcaaactgttgtgtcaacggagcattggcagacataccaaacattcttactcccatttcgttaattgcataggccgccagaaagtaaccaccaaacaatgccacagctacggcacaacaattggtcatcgctatttgaaaactttgcggtcctccccatccattcgtcagcaaagagccgataaagacggacaaaccgcataaaccaatcataggatagacaaaagccataaaaacttttcgcctatcctcttccatagaaatttcctcccaggccttggccggagaggaaatcaatttcattgctatattaaataattctttgtagttcaatttgttttaagtgtttcactccacgttgaatttgcggcaccatccaaagaattctttgaggagttggtctttgcatttacttttattttagttggttctactccagtagcttgtttgaatgcataaataacactagacagattatatgccttataagtagaagtatacttatcacgagtcacagtctcctctgaaccatctttaatcacatgattaagattcaatacaagttcagttgaccctgatgccaattcatcaaaatcatatgtgagtataaaagaatgcttattaagttcttctttctgcttttcgtctgtactctctacttttacccaatacataataggaattacaagatattgatcaaaaagtattcccggctgagttgatgtatcgctattaaaagtatataaaggtgcagtagcttcgttataatctgccgctttctctggtccttcagtagattttgcactaatagaagtcggagtacttcctgcataaagtgttacatcaagagtctgagaattccccggctgttgtgcagtatcaaactgataatagaagaaatagatctcccctatattcaagttaggcattgacaattcattaactaccagtttctgaccattagccaattcaaatgtagcaggaaaatagtttgtacattttgcgaacgcaggtccggtatatatcgtattatcatccccattcatacaagaagtaacagacatccccattaaaaccgtcattaaagctactaataaaaatttcatttgtttcataaacatattttttagagtttgcaaagatataaattctaattcacaattaataaatgcagatacttaaaaaatactgcatcgtttactttattatttttgcaaaaagttccagatgctcatctacataccttgctaccagcgcagtaacctgttcctccatatctaaatatgcctcttccaaatcatcaaaagcctcatattgctcatacatcgccatgaattcatcgtctgtccgttccttttccagatccttccggttggcatcatatatcttcttggctttatataccaatttagagaactcttccgccccccacagacgcataaccttggcaaaaggattatcaaagatatatccgccataaccgttctgaatcaactgacagaatccgccgaacattatttcatcacgaaaaatctgataagccagcaatgaatgctgttcacctgtcaacaacggcatcgtgtcagcagtcaattcaccaccgattacttccttatatttatcagtaaatacctggataaattcatccattccttcgcccgcagctttctgtaaagcggactccataacttctatcatagctttgttcaataaattattcagcaaagctactaattttattctatatctatctagtaatactgccacattctcactaaaacatacctgttggcggaattaatttaattcaaacccatgaaaacagggtatctcattctgctttccgatatccgccagataattgcataccgatatactttccctttcccggaaaaccctttaagcacatttcttttaccgttcaatagtatgcaaacaaccctataataacctgctttacaactattattgtcgcattttcaaagggagttcttcatcgttccacccaggtgaacaagcatgtccacctaggtgcgcagatctgtttacaagggtgcaacgatcggttcacccgggtggaacgatgaagatgtcggtaaaataacacacgaataaaggcatcaaatgccatagagataagtaacataatatataaacaacaagtaaacagcaaccaagatgctagatgtattcggcaactacttacgcaaaggacaaagaaatggaatgagagataccccaaaaaagagtgagagatagactgaaatgaagcgattctagggagaaaataatgagagatacttatttaaaaagtatctctcattctgtaatatactaattatatgcagattacacaaaaacagtgagaccgtgagactaaaatatttttttctttgcaggagttagctgaaagaaggaactcttttaagtctatctaatgcaaaaacatataactatttatgcatgtaaatgcattcctatggccatacctattaaataaggtattaaccaaatgcaccaaacgacgatactaaaacgattaaaatgccttttcgcctcggcagatcccttcacataagtccatatcgcccatgaagcatgtacaaacatcagaagaatggcaatcgtccccgttaccgtgtggatttcatcatgcaaatgcgttaattcggcaatatgctccatcaggctggtcccgactgcatcagacaccaatcctaaaagaaagaaaataatatgccataacttcagtttcttttgcagcctttctccccatacaccgatagtataaaataccaacgcagatgaaataacgcagattgccgctatcaaataatgtatatctacctgattcagttccataaaatttatatttcagataacaacaaagcaacgaatagatagttcgacgcatagtaatctttcacaaatgcaatcccgacttagcaaacgaagaaaaaacgtaaacggatttgtcacttttcacaaaaaagtaagatatggcgatttgcagaaacaaataaatcgactacctttgtgggcgatttagagaatcgtgactacgtatttttaattatatcactaaaaaaaagagctaattatgacttattcacacgaagtggaacacatgtgtgttgtaaagaagggtcctaaccacggaccggctcccatacccgaagaaggcaaatgggtaaaatctaaagaaatcgttgatatttcaggtttgacacacggtatcggttggtgtgcacctcagcagggtgcttgtaaactgacactgaatgttaaagaaggcgttatccaggaagctttagttgagactatcggatgttccggtatgactcactcagctgctatggctgctgaaatccttccgggtaaaacaatcctcgaagcactgaacactgaccttgtttgcgacgcaatcaacacagctatgcgcgaactcttcctgcaaatcgtttacggacgcactcagtctgctttctctgaaggtggtttgattatcggtgcaggtctggaagacttaggtaaaggtctgcgcagccaggtaggtaccctttatggtactttggctaaaggtcctcgttaccttgaaatggctgaaggttacatcaaaaatatcttcttggataagaatgatgaaatctgtggatacgaattcgttcacatgggtaaattcatggatgaaatcaagaagggaactgatgctaacgaagcattgaagaaagttacaggtacttatggtcgtgtaacagcagaacagggagcagttaaacacattgatccacgtcacgaataatataaggaggaaagaaactatgattagagaagtaaaattcgaaagccaagaccgtcgtatcaaaggtatcattgaagccttgaacgctaacggcatcaaagacatcgaagaagctaacgcaatctgcgaagctgccggacttgatccttataaaacgtgtgaagaaactcagcctatctgttttgaaaacgcaaaatgggcatacgttgtaggtactgcaattgctcttaagaagaactgcacaaacgctgctgaagctgctgaagctatcggtatcggtttgcaggcattctgtatcccgggttctgtagctgacgaccgtaaggttggtatcggtcatggtaacctggctgctatgttgcttcgcgaagaaactaaatgtttcgcattccttgcaggtcacgaatctttcgctgctgctgaaggtgctatcaaaatcgctgcaaaagcagacaaagtacgtaaagagccattgcgttgcatcctgaacggtcttggaaaagacgctgctcagatcatctctcgtatcaatggttttacttatgttcagactcagtttgattatttcactggtgagctgaaagtagttcgcgaaatcgcttactctgacggtcctcgtgcaaaagtaaaatgctacggtgctgacgatgttcgcgaaggtgtagctatcatgtggaaagaaggcgtagacgtatctatcacaggtaactctactaacccgactcgtttccaacacccggttgccggtacttataagaaagaacgtgtattggctggtaagccatacttctcagttgcttccggtggtggtacaggccgtactcttcaccccgataacatggcagctggtccggcttcttatggtatgacagatacgatgggtcgtatgcactctgatgcacagttcgctggttcttcatcagttcctgctcacgtagaaatgatgggattcctaggaattggtaacaatcctatggtaggttgtacagtagcttgtgctgtagacgtagctcaggctttggctaagtaatttcaacgattactacatattaaatccctgtaactgataaggttatggggatttttgttttcaatagtttcgttaatttaactgctgatttacttctctcctacttatcaaaagcaattaaaaatattgcaaatgattggctgaatttactgcatgaaactggctcttttggtcgtaaatgggttgcacgattaagagttgatttagggcaaaagtaggctaaaacgaagatagtttgtgtgcaatttgtgtgcaatttggcatttttgagaaactgcacacagaatcatgcttaacaaactattatacagacagatatagcatattaaaggacttccaaatgtctaattttaaatgattaaacaatggtaagaagttcattcgctattctctttttcataagagaaagcagagttagaaaagatggaactacttcaatcgaggtggttttaactgtaaatggagaaagatgttcattctcaacaggtaagaaagtgaaagttatcagttgggataagaacaagcaattagtaaaaggtaaagatgaagaagctacaagcctcaataactaccttaaatcagtcagagcaaagttatatgagaaagaagctgaattattagacagaggattcgttattacagctcaacttttatatgatgcttactttgataaagtagcgtgtttaaaagaaagaagtctattgagcgtattagaagaacacaatgcagagcgcaaagcaatggtaggtaaaactgttgcacctgctacttattgggtatttgaatatacaggcaggttacttaaagagttcattctaaagaaatataacagagaggatttgtacctaagagagttgaacattggctttattcaaggctttcactcattcctattaggtgaaaagaagatgggacaaaattcaagtactaaacatttgaaatttctgaagaagttattaaacttagcagtttccaactcctatatttccaacaatcctgtaaatgcttacaagatagagcgtataccagtagagacagatttcttagacgaagaggaactaaggaagattattaacttcgatactcccatctcacgttttgagaaggctagagatttctttctctttgggtgcttcactggattaagctacattgatattaaaacattagcaccagaacactttgaaaaagatagtgaaggcagaatatggattaagaagcgtagaatcaaaacaggtatactttcaagaatccccctactccctatcgctaaattgatactagataagtataaaggtggcaatagattaatcccaatccaagacccagcagatattaataagtatctaaaagatatagctatactttgtaatatcaacaaaagaattacattccattgcggaagacatagcgtattttctttctcgctaaaattcaagcacttgcaaaatatttcagcttaataggtaacgatttagaaaccagcaaaattctgtatttcacctcgttttgcagtaattcaaaagaacgctttatctattggcaaaggtaacaaaatttatttgattaacagtttgtatttgtgagttatttctctgctaaattataaaaaatatatagaatcaattgccaccagtagttttcataggtttcattaatcactataattttgacaaagtacagaaacgataatttaatcgtatactcaaaaaggcagttcatcatctattattgttggcggctcttgccgattacgcaccgctttcataagacgagaaattagcgaatcagattctttcccatgatacttgcgcatataatcttctattaaaaccttttgagcagcagaagaaaaattacggcgatgggtatcatccacttccgaatgacatttgatacacaggcattcaagattaccttctcgattatctgttttcacaccgttcttatggtgtgtttgcatataaaaatggtcgaaaccgtcctcaacatgggttccacagcgttcacaagtaaaactctttttggtgcgatagttgagagatatttcttcccaatttttaacataaccaaaaatatctacatcgtactcagcaggttcttctacatcccctgcttcttttagaatttctacaaaatcggtggaatcattcactcgcattgcttcttcatccatcaacaaacgcttgcagtaaccacatagttccattccctcaacttccacttctttatgagcatttcgagaatacacttttattggttctgcattggcaaaacggtaagcttcccgtccaaagttttcgatagctgtgcatttacaaacgtgaaacttaggttggctgacatgtccctgccattcaaaatagaaacgagccttatacataaaaccacggcgtttaactccttcatcatcaatataaaaaattccaccatcttcaaagagaatgcgctcaccgatgtcttcaggcagtacatcaactgtaccgactgaacgccaagcaccagcagttccaatctgtattcccatatcagtaaggcttttcttaaaattaggaaagtcacaaatcgggtcagtattgaagaaccaatcttcctctgcgtctatgtcaaaatcgaagctcatttggtattctcttttacaaaattctcaagaatttcatcaccggaagtaactattcgaaactccacacgtcgtgaagaagtacggtctataggtttaccagaacgaataataaaatctccatctgcatcaagagcttttccataagaaagcccattggcagtaaaccaatattcaagtaattgtttctgtttatccgaatacatttcaaactgtgacatagagcgaaagtatttaaccaccgccaatgctctatcttgggaaagcatggcattggctatataggggtctggatgtcgacttggcatcggtacatcatctgtatgtccctcaatacgaatttcttggatattagaacgtaaactatcatttaacagaatattgaaatagcggggtaaaaactcttctagaatttccttgaaacgaggtgtcaattctgatgaccctgtagcaaaaagaactgtcggttctttaaatttcatagtaaggtccttgcctattgtcatttgccatttgagagtgtcaccttcaaactctttaacaagtttattgtgcaactcattcttggtttccacataatcagtaaggacggattgattcttttgtacacggctaatgtaggcgattgcaacaaaaagaaaaatcaccatcaatcctgtcataaggtctgaaactgacaaccatacattcgttttagccatatctatctgcgtttacctatttgttctaccatcttagtaatacagttatcaagttcggcaagagtagcacttaggcgaccatagaattgacggtcaagcgaagtaagctgcgaattgagtgtttgtgacccctttgttatgataccaactccttcttccattttatcttttgtgccttgccaaaattgttccccataatcacgtattttgttaagttcttcaagtttcgcaatgagaagttgtactccatccacgaaattacgttgtttgcgtacccattcgttaagtttttgagtagattcgttaaacgattccatattagatttggaaagattggcagtttcatgcagttccttggtgacttcaatgaacctcttgtcctcaataataacttggttaagcgcatcaacaagctggtgtaatttaccaccttcactaacaagaatagacgtatcatcctttacgcgggtaagtgaagaagaagtagcctcgaaattatcagacatatctttgtactgacgagtaagcgaggttatcatttctttattctcctgttgccaaagattgagtttctccactgatttattaagctggtcaaaattttcttgaatgagtttgttaataagcgcgttcatttgtttttgaaattcttcggtcacttttttcattacatcgacaagagcttcggtattactcttcttgaggagttcggtgaattcattgaatttcctttctaataactcatttgttttggtcatattatcttctatctcaatgacctcgccgtgtattatttcctttagttttccaaccttttcattaatttcgtcttctgtaccacttataccagagattacatcaaggatttctccaagatgatgcgtatactcgctaacttcttgtgtatatttcaatacagaattaatagacacagtttgttcattcgtggcttcttcaaggttcccaaatgaaacaagcatagaagagtttacttcctttatatcagcaagagtgttctcttggctacgttgtaaaacaaccaacgagtcaatggcggaggtcatagttttttgtgtttccgacatcttagacattacctcaccaactgttcggtaaaaagccttgcggtcagcctcttgttctgtcagttgtttctgaatagagtgtatcgtttctgtattggcatcgctcatcgcttttaccgctttggttatttcaccagcggcttgatttatgtcggaaacacctccgtctttttcatcttgtttcctactaataaaagcagatagaatcatagaaccaaccatacctgccaaagatgtaaagaaggctgttttcaagccatcaagtaaatcagggatagagcgatcaaggtctgtggtgtcgaaagccatcaaacctttggttattccccaaaatgtacccaatacaccaagggtggaaaccaaagagggaaaaaattccaccatccggcgattagccactaatttctcactatttctatatctaaatacaataatggaacagaaaataaaaacaataaaaatgctacataagcaaacccatgtatcaattgaaatggacaagttcataacgaaatcttatttgagttgaaaattcaatgctttacaattaaatatataagtaatgcctgattacatcatacatactcataggttcaccgaaagtcgcatataaggtcttatgtgacattacatttaacttgtctaagtctggtgcgttaagttcgtttcttttcaatatgtcgaataatctcattattacagatattttattatttccttattcatctcttgccaagagacggttactaagaattattttgttgaaacagagtggtttgtgaatttttaaagtggaatttcggtaaacatacagtattttttgcaaaacaaaaacttggcaataggttagattttcagcgttttatgagctaagaatcattattttgcgtaactttgcattataatatccgtctcttggcaagcgttggactgattcgcaaaacattcacggttttacagcaaatccaatatcttcttattagctctgtccaccacagaagtatccagcgaagcaagataaatctgcgtggtgttctctgaatcatgccccataccttcgctgatgacagagataggtacattgcggcttttggcaatacttgcccatgagtgccgcccgacatacattgtcaagggtatcgacaagtccaactgttttccgattttcttcaacagatggttcaccctatgcagttcgttggtgtattgcttccgataatccttgttcctttttgtgatgataggtaaaagatattccgtttcatttatcgggtatttgtcaacaatctcctgcatacatctttcccatttgatgaaaagttgctgccccgtctttcgtctgcggtaggaaaggataccgttctgcaaatccttctttctcagataagccatatctatgaaagacattccccttgtgtagaaacagaacaggaacatgtcacgggcaaagtcaagattgggcttcaacgacaagtccagccctttgatgcgtttaagatcgttaagtgatatggctcgcttcaaggttttttccactcctgtataaacagatttgaatggatgccgctgccctgtcagcccgtcttccaccgcacggttatagaccgctttcagaacgcgcatatagaacgatattgtattgggtgagttgcctctgcctttcagataagcctcatattccgcaatcaagtcagcgctaatctggttaaacaagacctccttgtcattcataaaaccgttgaaacttcggaatgccgccgtataggtttccgatgtgcgtatcttacccaagcgtttcagccttgctatctgctgacagatgtaggcattgaacgattgctcctgtctgttatcctgaaaacgcatgcctatatcatccgccacaaatgtgccggattgggataaggcttgtataatcttgttcaacctatctttgtcccatctgatacgtgaacttatcgaaagcaaatgattgttccgctcttgttcatttggaacacggtgcaggatgaccgcttcggaatggcagtcccattccgaagcgaaaagtttatagtcggtatatatctgcctgaccacacggttgtgaatcacctgatagtagagtgtgccctccttgccgcctatggtggatgggcgaaacttgaccttgaccgatgccatatcagtccgatttggattggtaacacttctctaacgcccttgaaagttccacaatctcccggctcagtttcacaaggtcgatggtacacttctccagcttgtagagcaacgccatcgccttcttctccgagaagtggatgcgcagttccttgacaacctgattgtagttcgtgccgatggcacggaactgggcatggaaatccgacagcttggtgtagtagtccaccagcgtcttgtccaccttcagcaccttgaacttctgcccgaagaagtgcgccttgagaaagacggctttcgcgtacacgttcgattcctcgtacattgtcaggaacctgttccattccacatcatcgaagcgcaccatcacgcagtgcgtcttcgggttcaacttgggatttctcccgtacttgctcttctttttcatgcttcttattctttcaattttatggcttgtccattgtttaatctttgattaaggaaccccgaaattatccgactgcggaggataattctgcccacggcggtgaaggcattttcagttacttagaattattcgggtaactgaaaatatatcttgctgtgtctttgaggacacaaaaatcctccgcctgtcggattgatttccgagcgtaataaatcactttgggtatcggttaagccgatgaagtgtattcaccgacctgaccgattctaccgtaatcccgtcagagcctgcgccacagctcgatgtcattccgataggtgtcgaggtgcagacggacgaggttttcaatcagccccgatgcgctcatgccctttcctccgaggaagcggacaaccctgtcaagttcgtcacgcacctcctcgctgacgaacacgggcttacggttgacaatcttggggacttggagataagtggtgcggtactcctccagcgacagtctgcgctgcttgctgctgacacgcttctgcggcattgccgtttccccgaccgcctcatttgacggttcatccgccatagcggtctccgtttcctccgtgacggtcttgccgggctgttccggctcatccggctccagaccgatacgtctgtagatgtcattcatcgacttgggagtgtaggattccctgcgtcccatcttttccacgatttcacgagcctgctgctctgtgatgtttggctctctcttcattgtaaaaaacaaattgattaagttattgaatgtggtcttggtaagcacctcgaccgattatcgtgagcaaagtaagatgcttcagtgcagtctgtcaagcacttggattctgctcggcatttttgtgtggttttgctttatggcggttgctaaagcggtgcggacttcaccgtttttccggatatgaatgtccgaatgagcaaaggctcaaccacgagcgatttttaattaagcccttatttgagtttcggctcccctctaaaaaccgaaattaaggtgatagcgataatctataccccggacaacctctaccacaccagtgccacatgctgccagttctgtaaaatccattgtcggataacgtattgtatattcctttgcggcaaaaggaataacaactaaaagaaagacaatatggaaatcgtatcaatcgaaagaaagaccttcgaggcgatggtcgccaagttcgaccgcttcgtcagccgtatggatgccatctgccatcggcacggtgaaaagaagatgagcgagtggatggacaatcaggacgtgtgccggatgctcaacatcagcccacgcacgttgcagacgcttagggacaacggcacgttggcttattcacagataaaccacaagacctattaccgtcccgaagacgtgcagcgtatcgtctccatcgtggaggacagacggaaggaagcacgattcaaaggcaggactatataaaccaagtatagtacataactgataatacccactaaaatccaaagcgtatgaatgaactgattaacaaagacaacgagtggataatccacttcatgggcagcctcgaccgtctgctggacaatgtagagcatctgactgccaactatcgcccgacactgaacggggaacgtttcttcaccgacaaggaggtgtcggcacggttgaaggtgagccgccggacacttcaggactaccgtaacgaggggcgtattgcctacattcagttgggcggtaaaatcctctaccgtgaatccgacatcgaaaggatgctggctgacggataccgctccgcctaccgactgaaagcaccctgattttcttgaaggagcgcagtttgccgtctgcccatacttgcggaagcaatggtacaacaaaaaggaacggtttgcggatgaagcatcaatgtttagcttcatccgtaagccgttcctctatttcttctgatttcccgtcagtcgcttgtttccgttgccggatgcccaaaatgcgtgtggtaggcagtggcaaggttttcggactgaatacgctcaaatccgtttgaggaagattctgcccgaaacggctctgccgcctgaccttgccactgccgtcaaagtcacacgctatctttgcatccgagcatcgggaacaggtggctgacgggaaaatataattttagagacattttatcgagttgaaaaatactcttctctttgtcgataaattttatccattaaatatttgaacatccgatgatctaactctcctccacaattcatcatgatttcctctgtatcacgcatcaactttgtatattctcgatcagcttgttctatatccattttcaaagaagaaattttttctaatttgttaacaattcgttcatattcaatagctgcaattgagctacgcctagatataccttttcgcccctcatgtaccatcatttccatcatcattttcaggtcattcatttgtgaacgcataacatctaaagcaagcacttctttattagaattgtcaagattaggtataatagcaggggaactcaaggccattaacttaacaatagaatttatatttccagaatctccttctgccgctttagttgcttcaatagcttcttgtagacttttttggctttccagaacttcatgatatttcatctcttttgaatactcaagatatctcaagggagcaatatcaaatattttaggagtacctttttcttgtattaaaacgacaggcttatcaaatgcctgtcgtattcccagttcaaacaatacattgggattacgcgtacttaaatcacaaacagctatcggagcatctataagtttttttagtatatctaaatgaataaagtttgtttcctttacttcatctgcccttattgctgtaaactctgttttatctattgctggttttataatatcgtcatagacatgagcaaaatgtcctttttcatacccatcacaatcagcaataggcatgattacaaaacaatttttattttctccttttgacatatcttattaaattagattacaaatatagcaaattcctttgaatatgtattatataaaacaagcctttagatagcattatagctacaaggcctaaaaaactgatttaacaagacatattataaaattttgttatcatggtcttttattttcttttgaattttcagttacttgttttccgcacgaggatgtttcaaatgcgtgtagtttgcaatggcaggattttcgggtggaatacgctcaaacccgtttgaggaagattccgcccgaaacggctctgcagcccgaccttgccaatgacgtcagagccacacgctacctttgcatccatacatcgggaacaggtggctgacgggaggaatatcagctataccacaggttgccaccattgccataagaaaccaacaatgtgaccggatttcctttcttggtggcgcagattttatttattacgaaccgcctgaacaaatgggtttccttactgcatatcctgaatgcaatggctataatcatttcaaggctgtaaacgtcataactgataccatcgggttgcctgatatatcgcattgtatcggcttcgctcaactccttgttcttgtagattacccgtatcgcctttcggatgtcgcacgagaataccccgaacaggtcggctatttcaaatttggtcatccatacaggtacagtcggtatggtaactgctcctgtttcactgattgtaattattcctctgttcataatgcgtttattatttgatgtttattctctgttttatttcttttcgccagccgatattttctttctgcgctccatcagtttgtccatatccttggagattttatcatcggttatccgtgcatatccttgtgtcgtcctgatattagagtgtcccatcatcttagcgatactctcaatcggaatgtccgcagaaatcaggaatgttccgaagctgtgccgactttgatgataggtcaaattttcctctttccctatggatactcccaactcgtgaacctcaaaccatagggcatcacggttgggaagaggaaacacgggcttctcatcatcagttgtgttatacaacgacaatatctgctccgctatgggatgcaaggggatgaacgcctccacctttgtcttcttgcggttgatgcggatataccgtctgccctctgcatttgtcccgatatgatggggatgaagaagcttgatgtccacatacgccagcccggtcagggtcgaaaaaataaaagcccgtcttgccagttccatccgcctgtcatacatcggtgtggaaagtatcttcctgaactcctcgcggctgatgtacctgtgccttgcctccggctttgtctcatactccaagtcctcgcagggatttacacggataatctccttgtcgactgcaaggtacaacagccggttcagccaacacagacaatggttggtctgtgaaaccccgaagttcttgcatttcttcaagtgggctttgtaggacttgccgaaatcctccgtcacttcttcaagaggaagatcttttctcccgatagacgctataaagtccgtcaggtacttttggtagtacattgaagcccgataggaggatgtggaaccaatctcttcggaatgcttcttcaaccgctcccgttcccattcacccatctgcagaagggtagtcggatgaatattattcaaggatatatggtttttcaacatctcggcactgaccacgccttgcgatttaagtatctcggcataggcttcctccgtcagacgcaggtattcccgtaagcggttgttctccctgatggtctttatctcattcttcttgccgttccaatcttcggggcggcaatagataccggtacttatggcggtctgcttgccgtcaatggttatacggcagagtacggcggtcgtaccgtcagccttaatcttgctgcggttgatgtatggcaataatgaaaatgtgcttcgcatatcgttgttggatttatagggtcagtttgaaatcttgggtcgcttctatgaacttgtccatgtcctcgaacagttttttcggactgacacgggcatatacctgagtggtggaaatatcggagtgccccagcatccggctgatggtctcaatcggcacacctgcttcgagcgtgattaacgaggcgaaactgtgcctcgcctgatgatagcacaagtcgtctttaatgccagccaatgtcgccaacgccttcatgtgtcttcggagatttggccaatgcaataaagggaacagtgtgtccctgtcctcgctgtgatacttctcaatcagcgcaaccgcttcgggcaacagtttcacgctggcacggagttcgtttttctttcttcgatacttcagccacaaagccccgtcctcatccgtatatagattctcatgggtaatcgagacaacatccgcataacagaccccggtgtagcacccgaagagaaacatatcccttgccaacatgtgggatttgcggtaagcaggtatttccacatcccggattctctcaaacgattcacggctcaatgcccgtggtgtcgtttcagtcttcttcggcaaggtaaaatgccggaagtggattctgtcggcatagccatccttatacgccagacggcatatctttttcaaaatgacaagatgatggcggacggtatctatcgcatatcccttgttttccatggcgaatgtctgatagtcatggatgaactgttccgtaagttgcccgaatgccaaatccttgaccttgtactgatgcttgatgaactctccgagtgtcagacgcatatagtgatagccgggataagttcctttcgcacggtcaataccgatacgggctttgagatcatcacagacaacatccgtcattcgcatgagcgtcatctgtgtttccatgcagccttgaaaatgattcttcacatcggtggcatcaaaatccactttacggctcataaggctgtcgaaggcgttgttcaccgccaacagcagtttctcaatcctggcattggttgccaccgcctccttgctcttgccgttcagacggctttcacgtgggttccacagttcgggagtacaggatagcttgcagccgaactgcgccatcgtgcggttcacggtgatgcgtcccatgatgggagccttgcccgacttgtccagtccgctcttttttaggtagagcagcaccttgaatttttctactttcatacgcctatacttttaagtgcaaatttacttgccatataagcgtcccttgacacgcaaaacactgtgtatgagtgcaaacaaaacggtgaggatttcttttcatcgcttgtcgttacctattcccgtttcggtaactgcccggctaacggtttggtaactgaacaacctcaatattccgttgccgtttgcattttctcaactttgcaaaatactgaaatatcgcttattcctaacggtttacgtttaatctttacctgttcgctgtcgcttgctttgccatgtatattccatacaagtaggcatacatttgcaagtactgttacgcttgctaataatatatctctggaagtagtctctaaaatgatgggacatactaatacaagaatgactacgcattacgccaagttgatagataagtgtataggtgaacaaatggacaaattgatggatacattcacaggagagacagaatactaaattaaataatcccacttatagcaatataggtgggattaattttatacttttgtctatcagtaattaagataaaatagaccatgccaatagacaaatttacagaagattactacatagaaacagaataccagttacttaattacatggaacaggtcgctttaaagtttaatccagatatggcttatgatgatgaaggtaatatgtattcttatggcacgcaagcactagaacgatttaaaaggagatataacagaggtaaaatcagtatcaacttcaactatgaggactacttacacaataataacatacaagcaacattacaggaattaggagtagatatagagaagttctggtacttactactgtttgttatggattacacttctggttattgttgggatgcaatagaagttaaagaatcaccaaaggaacaactgaataagtttaccagtctaataacagataattgttctgatataaaccatatatctggtgcaacattcaatactcctgtaactattactattaatgtcaaaggcaaacagtcctataccattgacaatcctaatgcaatagcttatttaggaatgttgtgtgcaaatgggatcaatgggattgaagaaaacagtatcctttctttagaacatagcaaccttatagacaaaataacaacatctgattctatgcgtatatgcttattcgctaatatgcttctatacttctttgaaacaaacaagcaatttaataagagacagaaaaaaggtagcgctatttcattaagtaagaatctacttatatccagactcgcttactttactaagttaacgacaaacaagaactacctagaagatgatgacaatttaaagaaagtcatcaaagattatagcaacaaagagctatcaactataaacaatttctatttctaagcgacatacttcactaataatcagccttattcttatgtttcccaattaaaagggagtataagggtaaggcttttttcttccctattgatcctcctaaatcccctcatctttgcaatgtcaaaacgatgacagaagaacaaaagattaaaggggagcaagacagaccctgcaaattcctccctattaatcagttcaaaagccagtagttttgcagcgtaatcaaattaataacccattaaaaaaattaaagaaaatggaaacaaaagtaaatgcaacagttgagaatgtaaacgaagttattaacaatgaaaatgaaatgagcatgaagaacttgaatttattatttatcgaaggaaatcgcactgaaattgacaaatcaaatgtagttgaagcattcaacaagattaaggctttaggtttcattcagacaatgcctatcgaatacttccctatgaatgaagccattaacaatttaggtggtcgcaaactgttaaagccaacagttgtacgttctaaaggtgaaggtaatcctactatcagtaatttcaagattgtaatggaagaagtgaatccagaagactacattaaatttgatggagtatgcgaagatggacaacacagaactatcgctctgatgtttgaagacctcaaagaagttgaagctaaatacgctgcaattaccctacctaaagacatggacattttagcttatatctcccttcgtaataatggtaagaaatggaacaacgaagatttttatggttctaacatttctacaggagacaagagaacagattatattcttggtaaaatgaaagatggctatatcgctgctttcctctttaacgtgtacacttttgggacttcaaacctcactgcatcccagattaaagcagttcagcaaggatataagaaactctctgattttggaaaagtacaaataagtgctgacacacagagtaaaggagacagcattttaaaggcacttgatgaaaatgagtttatgagcaaagatagattatctggtagatttggaacaggcttaaagcaattctatggtgaaattgaaaaagacatagataaagtcatagccacaataagcctacttaacaaagatacttgggatgcttactttactcccaaagcaggtcaaagtatggaagccaaatcatataaagaagcattgattgaagtctctaagaagattgggtaacagtattaagagcctatgtgacagataggctctattcttccctgttttaatcagtaagccattaataatttgactttagataatcctaatataagagttctaaggttgtggtcttttcatttggacaccctctaaaagttcagtatctttgtattacttcaagcaaacaaaatacagatacttccccacttgacaagatacaccacaaataacctatctaaaatcaaattatcacaatggaagaatttacgtatgaacaaataagagtaaaagcactaaaacaaggagtaccagatactaaacagcacataggtatgtgggctacccttaataattacatgagatgcagaagaatgaaacaaggaaagagatataccacttatataccattacaaaaactagcttattaataatatgataatccacttaccaacaggaaagaaattcagtaatagaaaagaagctaagatattctttggtacagcttactatcttaagatagaacgagaaaagaaagatttgctatttactaatgatattcaatctgctaccaatgaatatgagaatacctcaaaagcaattacaaaacagaataagtaaaaggcaacagtatgctaccattaataagtcaatgctaaataagctcaacccacccaacctatacaggttcttctgcttatccttgtacagaaatgagtactataatgtgcgattaagaattagtgatatagctaaagttacaggtgaagatgaagaggcattaaagaacttcaataaggatatggataagatactaacaagaaagaaataccctattcctattaaccatcctgtgtatgaatttacaatgagaagcctttacaaaataccagtaatggaggaatctaactatataacgctatcttatctccttataaagttagatttaagtgtaaaggtaaaagggtattatattaagctcttactgattgcagaagatagcataattcctcttaagcctaaagatttagctgaaaagttaggaatgggtaagaaagcaatagaagattacaacatagacctatataatgcaggattactgaaatatctttccaagggatttagacttactccaaacgagctattattagataatgatattgcagtacaacgtaaagagtggttagccatatctggagatccattacctaacattaatatgaagtcccaataatagattaaggggattatttatactggttattaatataataagaaacagtacgaataatccccattcagtaataatcatactttaagatgttctaaagccactatttcttagtaaatgctacccattatagtaagtatagaagtagaaaagcaatgtagcgtatatactactcccctatattagtacccctaccttttaatattaaaggtcgtttcttgtaccagtttatctatgtaaaatagctaaagactaaattaaaacagcacaagtattactcaagcacgtttattataacctattaagccccccacctagaattgagataaatagaaacttttacgtgaaagtccatagaatcaatcgctgaaagtagtacctattttagttcatcatagcgcaatgttatgaatgactaactaatagaacacacattccaaactgattcatggactttcttatttaagttctcatttactcaaaattcacctattattcattattaaaattagagcttatgcaggaaattggaattatcatctttcttcttttagctattggactatgttttgccatttgtcctgtaggaggtatgcttatactattattatgtgtgattggcttattcaagcaaccaaaggaaaaccattctaaaagcataacttacagagactacatagaatttaccaaatacaagaaaaggaattagcttatgaagaatcagaaatgggaatcattatagttagtttacttaattctagtgatcattaatagcagaatgttatgaatagaaaagaaattgccaatgcagtaaatcatattactacattacaggaaaagttgtgtgattgtgagaacaacttacaatacatcaaacgcttgcaagcattaatgtattggttgcataagtttgatttttgcttagatagtgataacatacaacaaggagaatatgcagctatttacgaaagctatttttgtactggttgtggattctcattttataatagggtatgcaattctatcttagattacaagtatggtaacagacccttttaaattggttgggtatcctttattggatactcaacttacataagctaaatggtcgtttagtatttgtaacttactaagtaaaatggagatgaaaacattcgtagcatatctaagacagtccacaatgaaacagcaggtttctggtttaggagtggaagcacaacgagaaattattaagaatcacttaaaagacaatcctctaattactgaattcgtagaaactgaatctggtaagaagtcaaatagacctaaactaatggaagcactagcattatgcaggaaaactaattctgttttaatagttgccaagttagacaggctatctaggaatgtcgcatttacttctaagttattggaaagcgatgtagaaattgtattctgtgatttcccacaagctaacagattgatactacatattattagtagtatcgctgaatatgaagcaaaccttattagtcaacgcaccaaacaatccctacaagccaagaaagctagaggcattaaattgggaaagtctgaaaacctgatgaataagtttcagcaagcaatcagtaatagttctaaaacgaataaggctaaagctgagagtaatcctaataatatgcgtgcaatcgctttattacgttctttagtattacaaggaaagtcgctatctgaaatgacaaatctacttaatgaacaagggttcgttacttctaagggatgtaagttccagatagtacaagtgaaacgattactgactaaagctgagcttacttaatacaagcctcaactattaataaacaatagttcttgctattcaaaatgcttttgctatctttgtgtcgtaatctttcaccctaaaacgttaggtcactgaaagacgacatatttattagattacagagcgtattgatatattgtcttactgtgaaactggacatttcaacaaggtgaagacgataggcaagagcgctcacgtcaatgttatatacctatctgctaagatagtctatatatcgtttggcgtgggctattgtttattactcaccttaggcgtccagagctcttagaaataagagtgcctcacagtagtaatattcaatagttcccacgcttttcatttataatagcttccatagggaacaggtaagcacaaacaaatcattaaatatgtataagattaaattatgggcaactatattattagttgcattatgtacaggattctactcctgtagtggtgatgaagaagaagagaagattccaaataacttaaatcctccagaggcatatgattcctactttattaaatatggtattattgattataaagacatagagatacgtctaggaggtgagaatgatgaatatgcctacttttctggattaaagaataatcgactatggctagcttcttttgatactgagactaaacagaagcaagtagaatggactgatactgaagagtgtaatagagaacgtaaattagacttgggatatggagaatacgaaaatgttacactttcgtatataattcctatttattacatttcaaataataattttgttgtaatattagattacagatttggcaattctggtaataatgatgctttaagagaacactatgcaatattcaaatataattcatcgactaaaaaaattaatcttggaaaatacaacaattccaataaaggctataaggactctttctttataggtaactgttgttacacgcaaacaggagatacgatttatgttgcaccaaagttttataacgtaactcgccttatggtttcctatgaagaaggaatagaagaatctacaacttccattacacgatacaattataaggaaggagagatcatttggaatacttcaatcacacctccttttgacattccttctgatgctagaagtactattactcttcttgataattctactaacatttggaaatataaagttgactatacattctatgatggaacaaagaaagaacacacattctctataaacatagataatggagaaattcaataacttaacaatttagatttatgagaacattaagattaattggaatgaccttattaatggtcatgttagctgtaaactttgcagcgtgtagtaatgacgatgacgataaagaagacgctaaaccttctattgttggaacatggaaattagtttctagtgaaggtttagttgctactcatgtagcatataatagtaatggtacattcaaatacacaagtacaaaagaagctgattacgaagaacatgggaagtataagattgaaggaactaaactctacgaaatgttcagtgatgaggatgaatggtctataagtgaaatcctattactcaattctacgacattaacattacaggaaatggaagatgatggggtaactccttatggtaaaccttactcatttcagagagtggaataaactccatatattataattgccaaaggcagcattgaattactctttgctgcctttagttttcttaattagcttcttgcctacatattcttcatagagactaggaaaatagctcttttgtaatttagtatccataggacgataagttatatctgttgtcgctattgcccttctttcaacttccacatctattacactaaatgagatcaatagagactcatactagaggcttgaaactaagagataccaattatcaatttcgataatagaatcgctagaatcgaataatagaagtcaattagatatattcctaccactagattgccaataccaattttcaaattaatctattatgaataacatctttcttactacgaaacagactaaagcaattaaagtgctaatagataacctagattcagataatgaagcaatccaaagaatgagatatggattaagaactacagatacaggtgatatgacattagaagaagctcaaagtataatagatagaatgaaaccagaaaagaagaatgcagtgaataagatgttacttgagagtatacaagtctctcccaatacgtattataatatggagaagaacgctaatgagatatacaagagttggtggtttatccttataatgtgggtattcattataggaatgatagctttaggaattatgctagtttctattctatcagtaagtatatatggatacttctatggattactcaaattcatgttattaatttagcttggagttagttctttataagaaatattctatctttgcaccatagttatgattctataattttgaatttgtgacttattcacgaccacttattcaaaacagagagatttataatctggagcgttctttaaattatttcaatatttatctgtaaaacaatcatttacgattgatttgattaaattacagggatgctgtgtcgctgcttcttatggtatgacagatacgatgggtcgtatgcactctgatgcacagttcgctggttcttcatcagttcctgctcacgtagaaatgatgggattcctaggaattggtaacaacccgatggtaggttgtacagtagcttgtgctgttgacgtagctcaggctttggctaagtaattaaagttacattatataaataaactcctgtagtccatgtgattacaggagttttttatttgtggtaatttgaagtagatggtagttttagataccttatctcacctatcatttagaattgttgaatgatagatttatatacaatgaatagctacatttacataaaatcataatcaaaagaagcagcaggaacgcttgaaccagcagaaagctatgagagagggcaaatcgaagaattaatatcttttgccaactcaaatcatttatgaataactattatagtattgattaataacagattgctatagtttacaagaagccgaaataataggattcttgggaattggtaacaccccaatggtaagttgcactgtggcttgcgctgtagacgtagctcaggccttagctaagtaataaaagttacttattattatacaggagagaattttttataaggcactctcctatttttataaaaaagatgatgattgttacaaataatctacactatcgttgtttagttctctacaacaaattcttaccatgaaccagcttataacatatctttgcaatgagataataatatccataaattattaaaaagagaagaggatataaagagagaattttagaaaataaagaattacataaaataaactctcgaaaataatccagtatgacacacatcggacaaattattgaaaaagagctccatcgccaagaacgctcggtcacatggttcgcaagacgactctattgcgatcgaactaatgtatataatatatttagaagacagagcttagatacagaactgttgttacgtatatccattatattagaatacaatttcttccaaatatattctgatatatataacaacagaacatagaaatatcttctacaaccttgtatataaaacagcaacaattaaaaggatatttatgtttaaagagcatgtatctttgcaaagttttttaagacaaccaaagtatatgactaaaaagattacacattaaaaacaaaaaagatgaaacaatttagaattttaagtatgttgatgattgtgcttatatcaagcctgtcatttgtatcatgtggagatgatgatgatgaaacgtctggtgatttcagtgccagcatagcaggagtttatacaggtaaactcaaagttggaactaatgttacagctgatgcatatgtagtcactgtcaccaaagtatcttcttctgtagtaaaagttaccgctgacttctacacagataacggtagtgaaaattacaatgttactaaagaaggcaatcaatacattctttcaagcgaaagctcatctggtatcaacataactgttacaggtaaagcaatgactataagtttccttaataatgcaggaagtatgaccacttttaccggaactcgtgattaaagcccaccaatctttacagtaaaagtagaaattcagtaaaggttacaaatatcccaaagccgtaatttcccttttcttgaaaatgagaaattacggcttttataaataaaagctatgaaaattgtatataacactattctctttacattactatttctagccacaagctgtgatcattcggagaaaatcgatgatataaaacttgaaatttcacaaaacatcttccgcaacatcgacaataacggagggaaaataactgttgctatcacatctaattctgaatggatcatcgcaaattcagctgattggtgcataccagacaaatatcaaggagaaggaaacgatatacttactataaaaattctagctaacaccaaacatgcaaacagacaaactaatctaatcatatccgcccaagggataaaccaaacaatcaagatttcacaacaaaaaggagaagttaatccagatttagataaaatacactatcaattacccgttattttccatgttctttatcaaaacgaaaatgacataaatcaatatataaaagaagaccatttaaaagatgtattagtgcgaactaaccatttctatcaatctgaaaaatgtggaattgatataaatctcgaatttgtattagcaaccaaagataagaatggaaccacattaccagaacctggagtagaaagagtgccatttaatgagcttcctattgattgcgaaaagtttatgagagataatacaggaaaatatacatctttactatgggaacccaatgaatacattaacataatggtatatccttttacggattcgcagattttaggcatatctacatttccatatagtttaaaggacttttttttagaagggactcaacaggtatcagcttcgtggatcactttagagaatttgagtttcccatattgtatatcgatcaatagttcatatatttatgagcaaagtacagatgaaagaattaatcaaaacgatgctgcaataacattagcacacgaactcggacactatttaggattacgtcatgtattctcagaaggagggaccacttcaatgtgtaccgatacggattattgcaaagatactcccagttataaccgtagtgagtatgaacaatggcttaacaatttggataaacagaataaatatcaattaaaagatttagctaaacgatatagctgtgaaaaaggagaatatgaagcacacaacattatggactatgcatattgcttttataatgaaataactttagaacaacgaaaaagaatacgccatatcttaaactatagcccactgattccaggtcccaaagaaagcagaatagataccagaggcgtacaaggcagattgaatttgccaatatgtataatgaaataacataatcaggtaaaacggggcagcaagtatttcatcgactgttcctccatagtagtcaaatgtcagaacaagtcttgactattacaactaattatccgttttctacatcacaatacaaaacttttatacaggataacttgttattacaatataaccaaacatcatgaaacgatgctactgacatttttaaacatactggccaccatcattggcgtaatcagcttattgattgtaacctatggagtattcgtaggattcatcgcttttctccgtaacgaattcaaacggatcaacggaacctataccatcaataatgtccggcagctgagagctgatttcggcagttacctcttattgggattagaatttctaattgcatcagacatactaaagaccgtagtagacccgactttagacgaactggctattttaggaggtgtagttatagtaagaactgtattatcagtctttctgaataaagaaataaaagaactagccgaagaagaaaattcaaaaagcacataaatagattggaataaataaaaaatgtattacttttgcatgaattcttaatgacctatggtatggaatatatcaatgaatttcacaatgactgaaattccaaagaatataaaggacacgatatgaaaaagaacttactattattactttgcttgttttgtctggtcaatgtttgccatgcaaaagcgaaagacacttttaccgttttccaattaaacctgtggcatggatgtactaaagtacccaacggagatcaaggcattattgatgtactggatcagatggatgcggatgtcgtttttctgtgcgaaatcagagacggaaaacagtttatccctcatgtgatcgaagagctggagaagagaggaaaacattactatggtgaaacgtttgatcttgcaatcggtgttttgagtaaattcaagccggacagttggaccaaatgctgcatcgtacctggtgacgaaggtcgtgctatggtgaaaatggttgcaacaatcgaaggccaacccgtatctttctattcttgtcatttggactaccggcattatcaatgctatatgccacgtggatataatggtactacctggaagaaaatggataagccgataacggatgaagaagaagtcttgaaagcaaacagacagtctttccgggatgaaaccatccgtgcttttattcaggaagtacaatctgacattcaacaaggccgcccgataatcatgggaggagattttaatgagccctctcatttagactggcaggcagatacaaaggatttgtgggatcataatggggctatcattcattgggactgctcaatgatgctgagcaaagcaggattcaaagatgcttatcgtgaaaaatttcccaatacagttcgatatcccggttttacattccctgccggaaacaaactcgcagaagaggctaaactggaaaagttagcttgggcgcctgaggcagacgaacgtgaccggattgatttcatttattattatccattggagtcgatgctttccatgaaggatagcaagttggtaggtccctccgaaacagttgtccggggaaaaataacagaaaacgattctaaggataagattctgacgccttcttgtatttggcccagcgaccataaagggaatcttgctacatttaagattcggaagaaacggtaatagtatattgaatagggtgacatctacaggatgatatacatactctgttactacagtctcctttatctcatccgccaaatagcctactggtccatgcttctctatttgaactcatgttagtgttaatgtaaaaaggttgaatctgacaacttccccataaacaagattgttaattagaaactaattcattatctttgcattgaaaggagacagccacatgaaactaatagagaacaatatccagaagattatagacttatgcaagaaacataaggtacataagctatttgtgtttggttctatccttacaaatcgctttaacgacaacagtgatattgatttagtagtagatttcaataaagcagaagtaagtgattactttgataattactttgatttcaaatatgctttagagaatctgtttggcagagaagttgatttactggaagaacaaacgattaagaatccatatctgaagaagaatgtggatgcaactaaaactttaatctatggatgacttaataaagaaacacttgcaagatattctaactgccattgaagaagtggaaggtttcttcggcaatgctcctaaagtttatgatgacttctatagtaacctatgccttagacgagccgttgaaaggaatatagaaatcattggtgaagctatgaatagaatactaaaagttgataaggatatagctataaccaattctcgtaaaatagtagatgccagaaattatatcatacatggctatgatagtctatctgtagatatactttggagcatggttattaatcatctgccaaagcttagaaatgaagtcataacattactaaagacatgagattagttacacaaaattgtggacagtgccgtatatctgttctttcgcactcacacagatgtatactatttgcaccattaaaaatagaaaaagccagattaaaccatctgttgatttgcaacaaatgagctatcgttcattcccggacaacttatcgattaagacagcatcgatatcttttgccaattcttgataggtcgccaaaggatcatctgtatatacagcacgaataatcccctccttgtctgttatcaatatacggggaatggtatgggaagcaaaaagcgaaaagacagcatcatcattctgagcggaaaaaggcaaggaaaacgaatgtttttcccaataggcttgtacttcagagcccgattccgaacggctgatacaagacaataatacatccggattctctttatacgtatcataaactttctgaataaccggaagttctttctgacaatccggacaatccgtatgaaaaaagacaatcactccaaccttcccgctaaatgactgcgtattcaacattcccccatcactcatctctaccgaaaactgaggaagggcgtcaccggcaacaagagcaaagtctcccctatcatcatcatcgtccgtgatacaggaagaaaaaactgccagaacgatacatagcaatatcaccactttgcttcttatttccactttcatatctttcttcgttagttatgcaactcccaaaagctctacctcaaataccaatgtcgaaaaagccggaatcggaccggatgcacgggttccgtatcccatcgtgtaaggtatatagatgatccatttatctcccgcacgcatccgttggagcgccagttgccaaccatctattacatcgcagaggcggaaagcttccggacaattacgttcataagaattatcgaacacccgaccgttaatcagactccctttataatgaacggtaacaatactccgcacattaggaaaaacagtccccgtaccggtctccaaaaccttataatagatgccgcaaggcaaggcataaacaccttcctgcgatgacaattctttcaagaactccaaattcgtctctttatattcttgctttcttcccataaatacatgatttgaatgtacaaaagtaagcagatttaagagaaatcttccataaaaactgtatatttgtttgttgaatcataaaaactcatcgctatgggacaaattaaaaccagatgcagcgctgctgccggactattcttgattcttttgacagtaattgcgggattttcgtcctgtaaaagtaatcagaaagacattattccttctgccgaatacgctccatacgtcaatgcttatacgggaggagtgatttcgcaaaactcaacgatacgcatagagctgacacaggaccagccgatggtagacctgaatcaggaactgaaagacaatccgttcagtttctctccttcattgaaaggaaaaacgtattgggtcagcaacaataccattgaatttgtccccgaagaaggggcactgaaaccaggtgccttttacgaaggaaccttccacctgggagatttcgtcgatgtagacaaaaagctggaagaattcaacttctccttccgcgtgcaggaacgaaactttagtattcataccgatccgataaccgtcacagccacccagcccgaccaagtgaccgtaacgggtgaaatacgtttcagcgatgtagtgaaaaaagaggaagtagagaaaatgctcacagccggaagcgaaaagaacaaaagctatccgattgaaatcacccagacagatcacccgacccgatacgcatttagcatcagtcagataatcaaagaagcggaagattaccaactggaaattaccgccaaaggcaatccggcaggcatcgaccgtacccaaaacaaaagtattctgatcccggcaaagaacagtttccgcttcctgtccgccgtacgcatcgaccaaccggaaaacggaattgaaatcatattctccgaccctgtatccaacacacaggatttgaaaggactcatcgacgttccggaagtttcttcctctattttccagatcaaagaaaataaagtattcgtttacttcgaaaccggcaaactgaacaaactgacgctgaatatccatgaaggaataagaaacagccaggacaaaccgctgggcacttcccactccatctcattcagcgaactgaacctgaaaccgcaggtagaaatggctacttccgccgctatcctgcccgattcgaaaagtctgatcatccccttccgtgccgtcaatctatatgcggtggatttgagcgtgatccgtattttcgaaaacaacgtattgatgttcatgcagaacaactcgctctcctcagccaatgaattgcgccgttcgggaagactggtttataagaagacattgtggctggcgaaagattcttccaaagatgtgcaccgctgggaagactattcgatagaccttgccggattgattcatcaggagccgggagccatttaccgtgtcatcctctcgttccgccaggaatactccgcttatccttgcgggggaagtgaaaacaaggaaatgcagtttgcggacaacaagtcttccgacaacctgaccaaagtcagcggagagacattgtcggaagacgatgaagcagtatgggacactccggaaacatactattattataatggcagcgtaccgatggactggagtcagtaccgatggacagaacgggataacccctgccatccgtcctactatatgaattccgaccggatagccgcctgcaatatccttgcctccaatctgggaatgattgtgaaacgtaattcactgaataaattgtggattgcagtaaataacattttggatacgaaaccggtagcgaaagcacaagtgacgatttataacttccagcttcagccgattggaaagggagagacgaacggtgaagggctggtagaaatcactccgaagggagttcctttcatagcggtggccgaagcggacaagcaaaaggcgtatgtacgcgtggtcgatggcgaggagcagtcggtcagccggttcgatgtgggaggaaaagacattcagaaaggtctgaaaggatttatctatggcgagagaggcgtatggcgtccgggagatacactgcatatttctttcatgctggaagaccgtgagaaacgtattccggacaaacatccggtagcattggagatttacaatccaagaggacagttctataccaaaatgatctctacccaggggacaaacggattctatacatttgccgtgcccacgcaagccgacgatcccaccggattatggaatgcctacgtgaaagtaggaggaaccgctttccacaagagtctgcgcatcgaaaccatcaagccgaaccgtctgaagattacgctggctttgccaaccatccttcaggcttcgagcaaagacgtatatgccccgcttacttcttcatggctgacgggagccaccgcatcgcgactgaaagcaaaggtcgaaatgtccttatcgaaagtcaatacgcagttcaagaactacggacaatacctgttcaacaatccggcaacggactttacgaccgtccgggcggatgtgttcaacggggtactggatgcggaaggaagagcaggcgtcaacatacagcttccggtagcaacgggtgctccgggtatgctgaatgcaacgctcaccacccgtgtcttcgaaccgggaggagatgcaagcatctactcgcagactgttcccttctctccgttcacatcgtatgtgggcatcaatctgaaccagccgaaaggaaagtatatcgaaacagacaaagatcatgtgtttgatatcgtgacggtcaacgatcagggacagccggtgaaccgttccaatctggaatataaaatctaccggatcagctggagctggtggtgggaaaacggtgaagagtctttcggaacctatatcaacaacagttccatcactcccgttgccagtggtaacctgcagaccacaggaggaaaagcctccttcaagttccgcatcaattatccggattggggacgctatctggtgtacgtgaaagaccgtgaaagcggacacgccaccggaggaaccgtctacatcgactggcccgactggcgcggacgttcgaacaagacagacccgagcggcatcaagatgcttgctttctcactggacaaagattcttatgagataggagaaacagccacggcaatcattcccgcagccgccggaggacgtgcgctggtatccctcgaaaacggttcgaccgtcttgcagcagcaatggctcgaagtgtccgatcagggagatacgaaactcaccttcaagattacaccggaaatggctccgaatgtttatctgcatatcagcctattgcagcctcatgcgcagacagtcaatgatctgccgatccgtatgtacggcattgctccggtatttgtgaccaaccgtcagacgattctgcaaccgcagatcaagatgccggaagtgctgcgtccggaaactgactttaacgtgactgtcagcgagaaaagcggaaaaccgatgacttatacactggcgattgtggatgacggtctgctcgatctgactaacttcaagacgcccgacccgtggaacgagttttatgcacgcgaggctctcggcatccgtacatgggatatgtacgacgatgtgctgggtgcttccggcggacgttacagttcattgttcagcacgggtggagatgcctcgctgaaaccggcagatgccaaagccaaccgtttcaaaccggtggtcaaattcatcggtcctttctatctcgcaaaaggtaagcaacagacacatacgttgaagcttccgatgtatgtgggttctgtacgtgcgatggtagttgccggacaggacggcgcttacggaaatgcggaaaagactgcatttgtgcggacaccgctcatgctgttgtctactctgccccgtgtattgagtacgcaggaagaaattaccgttccggtaaatgtattcgctatggagaaccaagtgaagaacgtgaccgtatcgctggaagcatccggcgcaggcgtacagatcacgggcaatcgccagcagtcactcacttttgaccagccgggtgaccaactggcatacttcactctgaaaacaggcagcaaaaccggaaaggcaaccatccacctgacggcaagcggcaacggacagcagacaaaagaaacgatcgaaatagaagtccggaatccgaatccggtggttaccttacgcaacagccaatggatagaagccggtcaggaggccgaactgtcatacacactggcaggttcttcttcggctaacaatcaggtgcaactggaagtctcccgcattccgtcggtagacatcagccgtagattcgacttcttatacaactatcagcatcattgcacagagcaactgacttccaaagcattacctctcttattcgtctcccagttcaaggcggtggacgaacaggaggccgagaaaataaagacgaatgtacaggaagctatccggcagatatatgcccgccagcttcctaacggcggatttgtatactggccgggcaacgccgtcgccgatgaatggatcacttcttacacgggtatgttcctgacactggcacaagaaaaagggtatgccgttcatccgaacgtactgaacaaatggaaacgcttccagcgtgccgccgcccaaaactggcgtatgccgcaggaagcaagcaactggcagatatggcaatcggaattgcagcaggccttccgcctctatacccttgcactggctggtgcaccggaatacggagccatgaaccgcatgaaggaacagccgggactctccatccaagccaaatggagactggcagccgcctacgcgctgaccggtaagatgaaacctgccggagaattagtatacaacgcagaaacgaccgtcattccttactcttccatgaatctgatttacggttcgtccgatcgggatgaagcaatgattctggaaacgctcattctgatgaaacgggatcgggatgcgttgcaacaggcaaagaaggtatcacagaatctggcacaggaaaactggttcagcacgcagtctaccgcctttgccctgatggcaatgggacgacttgcggagcaattatccggtacactggatttcacatggagctggaacggcaagcaacagcccgccgtgaaatctgctaaagccgtatatgagaaggagatagctacttctccgaaatcgggaacagtctctgtgaagaatcaaggcaaaggagcattgagcgtagacctgattacacgtacccaattgctgaatgatacgctgccagccattgccgataatatccggctggatgtgaaatacacagatatggcaggttcaccgatttccgtggaagacatcagacagggaacagactttatgtctgcggtcaccctatccaatatcagcggtacttccgattacagcaatctggcactgacccatattataccgtccggatgggaaatatataatgaacggatgattgttccggaagcgtcctcttccaattctaatgaagcgaatactccggaaagttcagccgataagtacacctataaagatattcgtgacgaccgggtattgacttatttcgatctgcgacggggtgaatcgaaaacatttaccgtaaggttgcaggcaacttatgcaggtaacttcattcttccggccattcagtgcgaagctatgtacgacgcagcggtacaggcacgcaccaaagcgggaagaacgactgtcagccgctgacaagactctgaacaataagacagcattgacagatagcataagtgcatgggaagtaaaatcttgaatttcttcaaacgattgtccgtcaccaaaaaagtaatactttgtattcttgcttttttggtgacaggatatatcttttgtcttccccgccacctgtttcatgtcccctactccacagtagtgacggaccggaacgaggaactgctgggtgcacgcatcgcctccgacggtcaatggagattccctccccgaaacacgactccggaaaagatcaaggaatgcctcatcactttcgaagacaaacatttctaccaccattggggagtcaatccgttcgctatcggaagagctttctatcagaatgtgaagaataaacgcatcgtaagcggaggcagcacgctgaccatgcagaccatccgcctggcacgaaacgaatcgcgcaccttccgtgagaaactgattgaaatgatctgggccacccgcctggaatttcgcgcttccaaagaggagattctttccatgtatatctcccatgcccctttcgggggaaatgtagtgggactggatgccgccgcatggcgctacttcggacattctgccgatgacttatcgtgggcggagtctgccatgcttgccgttcttcccaacgcgcccgccatgattcatctgtccaaaggacggaaaacgttgcttgacaaacgaaaccgcctgctgaaacagcttctcgaaaagaaaaccatcgattcgtctacctacgaactggctatcagcgagccacttcccgacgagcctcatgcgctcccacaaatcgcaccgtacctggtcagccggttctatcaggaacgaaacggcgaatactcccgttcgaccatcaacaagggcattcagactcaggtagaggacctggcggaacgatggagtaacgaattcgggcgaagtgatattcgcaatctggccattctggtgattgacattccgagcaatcaagtggtggcatactgcggcaacgtccatttcgaccggaagcagggaggaaatcaagtagacgtcattcaggctccgagaagtacgggcagtattctcaaacctttcttatattacgcaatgttacaggaaggaagtttactgccggatatgttgctgccggacgtacctgtcaatatcaacggatttacgccacagaatttcagtatgcagttcgaaggagctgttcccgcttcggaagctctcgcgcgttcattaaatattcccgcagtcacgatgctgcaaagatacggagtcccgaagtttcatagcttcctgcaacagatcgggctaaaaacgatcaaccgttcttcttcccactatggtttatcacttattctgggaggagcggaagccactttatgggatgtaacaaacgcatatgcaatgatgggacgcagtttgttgcaactgccgcaaaggtcttgcagcctgttgctcccgacaagccgaatcacagaatcaaccgatccttttcagccaggcgccgtatggcagacattcgatgccttgaaagaagtcaaccgtcccgaagagatcgactggaaatccattccttccatgcagaccattgcatggaaaaccggaacaagctacggattccgggatgcttgggcggtgggtgttacgccccgctatgcagtcggcgtatgggtaggaaatgccaccggagaaggaaaacccgggctggtaggtgcacagacagccggccccgtactattcgatatttttaatctgctcccctcctcttcgtggtttacacgtcctgcgggcatctttgtcgaagcagaggtctgccggaaatcgggacatctgaaaggacggttctgtgatgaaacggacacacttcttgttttaccggcaggactgcggacagaggcatgcccctatcaccatctcgtcactttatcagccgatgaaagccagcgtatttatgaaaattgcgccaacacggagcctacgcttcgaaaaagctggttcacactgccacccgtatgggaatggtattacaagcaacatcatccggagtataaaccgctgcctccttttaaagccggatgcggagaagatactttccagccgatgcaatttatatatcctccgatgaacgcacgcatcaaactgcccaagcaactggatggcagcaaaggtttcctgactgtagaactggcgcacaacaatcctaacgctaccgttttctggcatcttgacgagacctaccaagcgcagacacaggactttcacaaaatctccctgcaacccgccgccggcaaacattcgctgacggcagtagacggtgaaggaaataccatctccaccactttctttgttgagtgatattcattatctttgcggcatgaaacagtcattgaaagaaaacggaggtctgccggcatccatcctgtggacgctcgccattgtggcaggagtctcggtagccaacatctattatatccaaccgctgctaaatatgatacgccatgaacttggcatatcagaattccgtaccaacctgattgccatggtcacacagataggctatgcagcgggactcttgtttatcactcccttaggtgatttgtatcagcggaaaaagattatccttgtcaatttctttgtcctgatattctccctgctgacgattgctttggcagataatatccatctgatactccttgcttcgttcttcaccggagcctgctccatgattccgcagatattcattcccatagccgcccagttctcccgtccggaaaacaaaggcaggaatgtcgggatcgtcctatcgggcttgctgaccggaatcctttcttcacgggtggtcagcggattcgtcggcgaactgttcggatggcgcgaaatgtattacatcgccgcaaccatgatgttcgtctgcgcgattgtcgtgctcaaagtccttcccgatattcagaccaacttccggggcaagtacggcgacctgatgaaatccctcctggctttggtgaaagagtttccgcagctacgcatttattccattcgtgcggcgttaaacttcggttcccttcttgccatgtggtcctgccttgccttcaagatggggcaagccccctttcatgccaacagcgacatcatcggtttgctgggattatgcggtgtggcgggagcattaaccgcctcctttgtggggaaatacgtaaagagagtgggtgtccgccgcttcaacttcatcggttgcggactgatcctcttttcatggctactcttcttcgtcggagaaaacacctaccttggtatcattctgggaattatcatcatcgacataggtatgcagtgcatccagctcagtaatcagaccagtatcttcgaactgtcaccccgagcctccaaccgcatcaatacaattttcatgacgacctacttcgtcggcggttccctgggaaccttccttgcgggtacattctggcaattgcacggatggcatggtgttattggaattggagctacactgacctgcatttctttactaattacaactttgtcgaagaagtgagtcaacaaaacggagcagtaaaccgtttaatacaaaaaaagggaaacatgaaatacggagttaacaaagaaatcttacttatcacagcaggcaccgtctggattatcgccggtgccaatatcttgcgaataggcatcgttacatggcttaataactccgaaggctggatgttcaagataggagaagcaaccatcgtctttctgctgttcttcgtattaatcttcaaaagactctattacaagcatactcaaaggatcgaacggaaaaaggaacagaagaactgccctttctccttcttcgatgtcaaaagctggatcgtcatgatctttatgatctgtatgggcatcaccatccgcagcttccacctgttgcccgaaagttttatatctgtcttctacacaggactgtccatcgcactgatcctgaccggtgtactctttatccgttactggtggctgaggcgcaagacgaatccggtgtaacaggaaagcatctatattccaataaaatataaacttataataaattttattgtgctgtccggcaaggtaaaaagaattctgtctttttattgtatctttgcgcgaccaaaaaaataaagaaatgattccaacccaacaggatattgccgaattcacccgctttcaacgaaacgagataacagaaagcatcttatatgaacggctcgcatctatcgaaaaagacgagaataaccgcaaaacgctccgactgatagcagcagaagaaaagtcgcattacgctatcctcaagaaatatacaggaaaagaaatcggtccggactataagcgtatcgcccgtttctactttctggcacgcatactaggtatcacattcgccatcaaattaatggagtccagtgaggaaaatgcccataataattatgataaatatgcccatataccggacctacaacggctggcacatgaagaagaagtgcacgagcaaaagttgatttcacttatcaatgaagaacggctggaatatatgggatcggtcgtactgggacttaatgatgcgctggttgagtttacaggtgcactggcaggtttcacacttgccttgagtgacagtaaactgatagcactgaccggcagtatcacagggatagccgctgcactgtcaatggcatcttccgaatatctttctaccaaatcggaaggggatgataagaaacatccggtaaaagcagctgtatatacaggaatcgcctatctgatcacggtagtgtcactggttactccgtttatactaatcagcaatgtaatcgtagctttaggagtgatgctgaccatggcacttatcatcattgcccttttcaactactattattccgtagcccgtggagaaagcttccgaaagcggtttacggaaatggctgtactcagtttcagtgtggcaggtatcagtttcctgataggatacgctctaaagacatttaccggaatcgatgcctgaaatcaataaagcatccgacatcattgaaggtccggcagttacataataaagaaacctaaaccaccagattaaataataaagcgttatatttagaatgaagaaagctccatctcccctcgtatcactattgcccattgtcgtattagtgatattactattcgccaccattcgtgtatttggcagtgatgccctcaatggcggaagtcaggtatcgctgcttactaccaccgccgtttgtatccttatcggcatggctttctacaaaatcccttggaaagactacgaactggcaatcacgaacaacgtggcaggagtgacaacagccatcatcatcttactgattatcggcgcattaagcggtatctggatgattagcggagtagtgcccactttgatttattacgggatgcagattatccatcccagtttcttcctgacatccacctgtattatttgcgtattgatctccgttatgaccggaagttcgtggacaacgatcgccactatcggtattgccctcatgggcatcggaaaggcacagggatttgaagaaggctggattgcgggagctatcatctccggtgcctatttcggcgataaggtttctcccttgtccgagacgaccatattggcggcatccgtcacggacacgcccctcttccgtcatatccgctacatgatgattactacggtgccctcactgatcatcacactgattatatttacggtagcaggtctgtctcatgacgccagcaatacccagcacatcgcggaagtggcagctgccctgaacgaaaagttccatatcaccccgtggctgctgattataccgatagcaacaggcatattgattgcacggaaagtgccttccatcattaccctgtttctgtccactctattggcgggcattttcgctctgatcttccaaccggatttgttgcgggaaatttcgggggctgccgtttccaacttcgactccctgtttaaaggactaatgatgaccatctacggcaagacaagcctgcagaccgacaatgctgttttgacagatttaattgccacccgtggtatgtcgggaatgatgaataccatctggctgatattatgtgccatgtgtttcggcggagcaatgacagccagcggtatgctgggaagcatcacatcgctcttcgtacgcttcatgaagaaaacggtcagcgtcgtatcggctactgtctgttcggggcttttcctcaatctggcaactgccgaccagtacatcagcatcatcctgaccgggaatatgtttcgcgacatttatgctaaaaaaggttacgaaagctgcctgctcagccggaccaccgaggattcagtaaccgttacatccgtactgatcccatggaatacctgtggaatgactcaggctaccatcctgagtgtgcctacgctggtgtacctcccctattgctttttcaacattatcagtcctttaatgagtatcgctgtcgcagctatcggatataaaattgtaaaacgcccgtgaacaatctggcatacactttgtttttgcaataaacgaacaacgtattaaacctaaacaaaaaaaagttatgaaaaagtttattgcattattagcattagttttagtaagtgcgagcacaatgatgtatgcacaggaaagtaacgcagccatccgccgcgcagacagaaaagcagaaagagacgcagaaagagcaaaacttcgcgcagaagaacaggtacaggacatggcagcctaccagcaggctgtacaggctttgaagaacaaacagtttgttctggaagccaatcaggtgatcttccgtaacggtatgagttccttcgtgacttccaacactaacttcgtcctgatgaacggaaacagagccactgtacagacagctttcaacactccttatcccggccctaacggtatcggtggtgtgactgtagacggtaactcttcggacatgaagatgaatatcgataagaaaggaaatgtaaactgttcattcagtgtacagggcatcggtatctcagctcaggtatttattaatatgagcagcggtaacaacaatgcttcggtatctatcagcccgaacttcaataacaacaacctgacattgaacggtaacatcgtcccactggatcagtcaaacatcttcaaaggacgtgcctggtaatccgaacagaagaatataagaataactccgctacaaatcgcgcaaaatgcgtacatttgtagcggagtttttttaattgatcattatgagggaatatatcatcgcagataatcaggatatcagcaaggcaggaatgatgtttctgctaagccggcaaaaggatgtatccgttcttttagaagctgacaacaaggccgaactgattcagcagctgcgcctgtatccgcaagcggtggttattctggattataccttattcgattttgccggagcggacgaactgatcgtcctgcaggagcggtttaaagaggccgactggattctgttctccgatgagttaagtatcaattttctccggcaggtattattcagcagtatggctttcggagtagtgatgaaagataactcaaaagaggaaatcatgtccgccctgcaatgcgcttcacgcaaacaacgatatatctgcaatcatgtcagcaatctgctgctttcgggaacggcttcttccgccgcatcccctgcaacggtggatgatcatctgctgacgcagacagaaaagaatatcctcaaagaaattgcactggggaagacgacaaaagaaatagcggcagaaaagaacctcagctttcatacaatcaacagccaccgaaagaatatcttccggaagctgggagtcaacaatgtgcacgaagctaccaagtacgcgatgcgtgcagggattgtggatttagcggaatactatatttgacagccggttcagttctgaaagggaacagcctatcgggttatctcaccacttcctacacatatccccgcttcttcatcataaatcaccccgaactgaccgggagcaatgccctgcaacttctcagaagataagatacggaactgaccgccctcttcctgtaccagctttcccttcgtaaattcaggagtgtgacgaatcttgaaggtaatatctatctcctttccggcatctttccacggattctccgtaataaagtggaaatcattgatacggaactcactgccaaactgcgtttcgactccatatccatgagagacatagatgatattttcctcaacatccttcttgatcacaaaccagggaccgccactcaatccaagtcctttccgctgtccgatcgtatggaaccagtagccgcgatgcgtgcccactttctttccggtttccagttctataatcgccccttcccgctctcccaggaaacgacgaacgaaatcattatagttaatctttcccaaaaagcaaattccctgactgtcctttcttcgggcactgggcaatcctgccctgcttgcgatttcgcgtacttcctgcttcatcagtccgccgataggaaacatcagtttggaaacttgcaggtagtctatctgggccaggaaatccgtctggtctttaacagggtctttggctgttccaagccacgtcttgccgtcctgccggatggtggtggcgtaatgccctgtcgccgtaaaatcgaaattctttccgacctgctgttcgaaacagccaaacttgatgagtttgttacacatcacatccggattcggtgtcagtcctttctttattttatcaatcgcgtaggcggccacattctcccaatactccttatgcaaatccacgacttccaaggacaaaccatacttacgggcaatggcagtggatatttcaatatcttcttcggccgaacaatccatatactccgccccatccatacctattttgatatagaaaagagtcggtttgtatccttgctcacaaagaaggtgaacgacaacagagctatcgacacctccggacaataatgcagctatattcatcatcataattattcgttaaacaacaaaagttgtgctaagatgccaatgtattaatcaccgacaaattagcacatcagcaaatctgtttcattaaatctttgtcaaagtcaggttacggtccatccaaaaatcatttactctatatcactctctttggattctaattattctctctctatttatatgaatacctattgatcattttcgatgttgcaaagataaggcgggatttgctaacagcctatcacatattgaaggcatttttataccataaatgtggtagataagcaaagtatttcctacatttgcacactgaaaagctttttaagatgacgaatttacgtaaaatactacttatacctgccctgatcgtcgtatctgtcagcagcttcttttcgtgcggtgtggaccgctggccggaatatgcccacctgactgaactggatacatggatgtatgatatcatgcaacagaattatctgtggtatcaatatatgcctggctacgatgaagtaaacctgtttcaggaccctgccaccttcttatccaaagcaaaatgggacaaagacagctactcttttgtagattctgttctggaagctccgttgccaacctatggattcgactactcgctcgtcaagagtcaggataacgatacggcatacaatgccttgattacttatgttatccccgaatcacccgccgaaaaagccggactccaacgcggtgactggattatgaaagtagacacttcctatatcagcaagaagtatgaaacgcaattgctgcaaggtacaatagccagagaactttcgatgggggtatggaaagaagtcgaggaagaacccgaagaaggggaagaagttccggaagaaccggttatggtgtataaagtagtaccgaacggtgtcacgctggatttgggagccgcccagtctatagaagaccaaccggtacataaatacgaaattctgactttagacaatggtgctaaagtcggctatctgatgtacaacagcttcactgccggaaccaataacgatccggagaagtataataatgaattacgtaaagtctcaacgatattccaggaagccaacgtacaagccactatccttgaccttcgctataacgaaggaggatcgctggactgtgttcagttacttgccaccatccttgtgccaaatgcaagaatgggcactccgatggcttatctggaatataacgacaagaacttggacaaagacgcgaccatcaatttcgatcaggaggtgctgaagaccggtgtcaatctgaatcagaacactttggtagcaatcaccagcggaacaacagccggagcagcagaaatgctactgaccagcctatacaaagaggatcaggctcctaacattattgtcatgggtagcgcaagcaagggacaaacagtggctacagagcaattcatcaatgaaacctaccgctggtctgtcaatccggtggtatgcaccgtttacaactccgaccatgatgcaggcgaagacgcatttgtgcttgttcccagcgataaattcaaaataagcgaaacgtctattaacgggactactgattacagccagttcctccctttcggcaatcctaaagaaagaatgctaagcatagccatccagacattggagggaacctatccgccgaaagacgaagacaaagaagaagaaactcgaagtaccaagagtattaagatagaaaaaagtgtcagcagtcctgccagcagaagatttgccggagggttacggattaaataaacaagtatgaaaaagatagcacttctgttgtgtgcgatagtaatgttcggttgttcggatgatgaagaaaaagcaggcacagaagttcctgacccggaaataagcaagatgctgttctccgaattttgcaagtccgatggagccggggtatctgatgttagtaaaaaggaagagtttcactacgaagatacctggctgaccggttatacctacacgcaagaagtttcgatagcggacttgacagagatcatcagccatccgcttaccatccaatacggaaacaacagaagcagtgttactttcacagacgaaatagggactgagcgtaaatacaccctaaacgaagaaggatacgccacgcaatgcgaatatgcttctctcgaccagaagagacaatataccttttcatatacggacggctatctgacacaagtgaatgaaaagattatgccccaggaaggaagcagcgatgcagttgtcgcgcacactctttctctacagtatgacaagggcgatttaatttccaccatctctccttcactgccctatgaatcatccaccggttacggaaagcttcagactaattatgaagcgggagaagatatcaattattatcgtcttccctgtatgctggtggcggatacttatcccctttccttccatcgtgaagccttgtttgccggcatgcttggcaaaccgacacaacaccttactatcgcctcttatccggagaaaaccagtgacacatacaccgaaagaaccgaatatacttatagctttgataaaaacaagaaacctgtcagtctaaaggtcagcactaaatatggtaatggcaaaagtatatcttatctgaatcgcacgatctcaattacgattgaataacccgattcttgtcaagagcagaattatagattcttaactccgactggccttttccgctacataaaagtctgtttatcgaaacaaagcctccgttttcacctaacaaagcatctgattacacttaacatagtatgtaatttgccttaacataccttctaattcttcccgacatcccttctaaatttcaataagcaccaagctgaaccactcccagcaccgatctgaacagttcctcaccaagtagtacacaaaaaaaggagaaagttttcacttcctccttctatcgtagtttaatttcaatctactatatgattatgtctccaaagatacgacatccggatgcaaaagtcaagcttttccggttttatttcttgaagaatttatcaaagaacaaaatctggtaatcgatagcgttattccagtattctccggtatgtcctccgggacgggtgataaaatcatgatcgatcttcttttccaataagcggttgtgcaaatccttattcacctgaatgaagaagtcagcctcgccacaatcaaagataattgccaaatccccgttctgaatcttatcaatctgattgattacagtatgcgtgtcccatatttccttgttagattcataatcccccaggcgttttgccatgtcccaattcttcgggaacggacgaatgtctacgcctccacttgtacttccacaagcgccaaaggtatctttatgacggatagcagtccacagaccaccatgtccgcccatactcagaccggtaatggcacgccccttgcggtcggtgattgtcttgtaatgtccgtcgatatacttcaccagttccgatgagacaaaagtttcatatcggaaagacgggtctttcggactgtcccaataccagctggtacttccgtccgggcaaacaaaaatgattcctttctcatccgcaatctgaggcagattgggtttaatctcaatccacgtcttggcatgtccgccaaaaccatgcaagagataaacagtaggacacgccgtagctttctttcccaatgccgcatccggagtgactactactaccttgatgtccttgttcatggaaggacttttcactaataacgtatctactttggcagcaaaagaagacgctgccccaactaacaaaagagcgattaatagaagttttttctttttcattgtgtttataatatgtttagatccaatcattcttcgtcttctcccgaaggttgaaattcggcaacaggtgtctcaaaagtctgatgacactgctggcaagtatattcccaatgattgtcccccggaggcgccgctgccagcatggaaagtacagccgcgccaacagcacgcagtttgtgtccttttctcaatacgaatttaatatcggacgaaccgcaataaggacagagcgtcagttcttcgggccagctttggttctgcctcagcacctgaacggctttctcataatcttcatccgctaccaggatatccactcccgcaatactgctcacgcaacttttatacaaagtagaaaagttctcattatgcagaatagattcaatgccctcattctccagcgccccttgaaggatatgcgccttcatcgcgtcattacaggtaatcaattttacggttttcatacttaaccagattttattattcccacaaaaatagaacataaaattgaaatgtgaaactattttccattaactttgcagtcgctaaactacaaataacatgaaaagactactgtcgcttctgctgttttgcaacataaccatatccttccttctggcacagcctgtccaccaagtgaagggaacagtcattgataaatccagccgtcagccgttggaatttatcaatgtaatgattgtcggactcaataaaggcggagtgacgaatgccgaaggtaagttctcgatcgggcaagtaccgcccggcatctatcgcctgcaagcgtccgctatcggatacaaaactgtcactacccccgaatacatactttcgaccagagacctacatatacaaatagagatggaagagaatcagacggaactggaaggagtgaccgtcaccgcctcccctttccgtcgggacattgaaagtccggtcagcctgcgcatcatcggattgcaggaaatagaaaagagtccgggagccaaccgggacatctcacgcatcgtacagtcttatccgggagttgccttctcaccgataggataccgtaacgacctgatcgtacgcggtggatcgccttccgaaaaccgcttttacctggacggagtagagatccctaatatcaaccatttcagcacacagggagcatcgggcggtccggtaggtatccttaatgccgacctgatacgggaagtgaacttctataccggagccttcccgacagacaaaggaaatgcgctcagttccgtgctcgacttcaaattgcgcgacggggacatggaacgcaattccctaaaagctactctcggagcttccgaagtctcccttgcctccaacggacatttgggcaaaaagacttcctatctggtttccgtccgtcagtcctacctgcaattcttgtttgatatgctcgggctgccctttctgccgacttttacggatgcgcagttcaagctgaaaacaaggtttgacgcccggaatgaattgactgtactagggctgggcggcattgataagatgaagctaaacaccaaagccgacgatgaagacaacgaatacatcctcagttacctgcctaagattcagcaggagacgttcactctcggagccgtataccggcactatgcgggggcacacgtgcagtcagtcgttgccagtcacagttatctgaacaaccggaacaccaaatatcagcagaacgacgaaagcgatccggatcgtctgatgctccgcctccgctctacggaacaaaatactcagctccgtcttgagaacagttcgtctttccgcaactggaaagtcaccgtcggaacctgtctggactatagccagtatagcaacaccacctttcagaaggtatacaccgaccgtgcgcagacgttcgactaccatacctatctgggcatcatgcgttggggacttttcggaacagtcaattacacctccatagacgagcgttttacggcttctctgggactgcgtgccgatgccaacaactactcggcagccatgaaagacctgtccgaccagctttctccccgcctgtcgctctcctatcaactgacggagcactggtcgctgagcggaaacgcaggactctattatcaactgcctccctacaccgctctcggctttaaaaacaataacggactctatgccaacaagtatgcgctccgctatatgcaagtcagccagggtagcgtaggactgaactggagaaagggcgataccttcgaagtatccgtcgaaggattctataaagattatgacaaaattcctctttccgtagccgacggcattccgttgacctgcaaaggaaacgattacggagtgattggcaatgagctgcttacttccaccgcacagggacggtcttacggagcagagcttctccttaaatggctggtcgccaagaaactgaatctcgcctcatctttcacgctctttaaaagcgaatatcgtactgataaggaaagcgaatacatcgcttccgcatgggacaaccgctttattttcaacttgcggggaacttacaatctcccccggcactggagcgtcggaatgaaagtcagctgtataggcggtgccccctatactccttatgatgccgacaagtcatctctggtaacagcctggaatgcacagggaaaaccgtattacgactatacccgatacaatgaagaacggctctcggccttcactcaggtagatatccgcatagacaaaacattctatctgaagcgctgtatgctgggtttctacatcgatctgcagaatatcgcgggcagcaagctgaaacaggcagatgtattaatgagcaccggagtaatcaaaaatccggacgcaccgatagccgaacaacggtatgtcatgaagtcgctcaagcaagaaagcggtacactgctgccgactttgggaatcacgtttgaatactaacactatattatataataacaaactaaaaattcactatgatgaaaaaacaaattgcattagtagccctgttatttttgggcatgagttgttttaacgcttcagcacaattcaagaaattcaatttaggcaaagctattcaagcaggaaaagatgccgcacaagcaatctctctatctgacgccgacattgctgctatgagcaaggagtatatggaatggatggacaagcataacccactgaccaaaccggacagcgaatacggaaaacgcctggaaagactgaccggaaacatcaaagaagtagatggtatgaaagttaactttggcgtatatgaagtagtggacgttaacgctttcgcctgtggtgacggcagcgtgcgtatctgtgccggactgatggacgtcatgactgacgaagaagtaatggcagtaatcggtcatgagatcggtcatgtcatccataccgactctaaagacgcaatgaagaatgcatatttccgttcggctgtaaagaatgcggcaggagcagccagcagccaggtcgccaaactgactgactctgaactgggagcaatggcagaagcacttgccggcgcacaatactcacagaaacaagagtacgaagcagatgcctacggcgtagagttctgcgtaaaaaacaacatcgacccttatggtatgtacaaatcactgaataagcttctcgaattgtccaatggggctcccgcatcttcctacatgcagagaatgttttcttcacaccccgacactgccaaacgtgtagcccgtgctaaagaactggctgataaatacaaacaataaaaaagactcaagatcagaaattacaaaagaacatattccgagagcatttactttgcaacctcggaatatgttcttttgttcttaagccccctcatttcaaagaatacatcaccattccgcaccaattgtttattaaaaaatcattaatatacagcacatatttgcatgatgtcgtgatttcatgtaatttcacggcaataatcatttaaatccatttatggaatttcttatcatacttctcttacttgtactgaatggcatctttgccatgtacgaaattgcgctggtatcatccagcaaagcacgtctcgaaactctcgccggaaaaggcaacaaatctgcacgtggagtactgaaacaactggaagaacccgaaaagttcttgtccaccattcaaatcggtattaccctgatcggtatcgtatccggtgcctatggtggtgtcgctatcgcagacgaccttgttccgctcttctccctcataccgggagcggaagcctatgcacgtaatctggccatgatcaccactgtggtaatcatcacctatctctctcttatcatcggagagctggttcccaagtccattgccctcagcaatccggaacggtacgcaaccttgttcagcccgattatgattttattgacgaaagtatcctatccgttcgtctggtttctcagtatctccacccgcctgctgaacagaatcatcggcgtaaagaacgaagaacgcccgatgacacaggaagagatcaaaatgattctccaccaaagctccgaacagggagtgatcgacaaggaagagacggaaatgctgcgtgatgtgttccgcttctcggacaaacgtgccaatgaactgatgacgcaccgcagagaccttgtcatcttccatcccgacgatacgaaagacaaggtgatgaagacaatcgaagaagagcactacagcaaatatctgttggtggacgagcggaaagacgagattatcggtgtggtatccgtaaaggatattattctgatggtaggcaataaaaaagagttcaatctgcgcgaaatagcccgtccggctctgtttatccccgaaagtttatatgcaaataaaattttagagctgttcaagaagaacaaaaacaagttcggagttgttgttaacgagtatggtagtacagaaggtatcattaccctgcacgaccttaccgaaagcatcttcggagacatccttgaagaggacgatacggaagaggaagatatcgtcagaagacaggatggttcgatgctggtggaggcttcgatgaacatcaaggactttatggaagagatgggaatcctatcttatgaagacctggaggacgaagacttcacgaccctcggaggattggcaatgttcctgctgggcggtatcccgaaagccggagatatcttcacctacaagaacctgcaattcgaagtagtagatatggaccgcggacgggtagacaaactgctggtcatcaaacgggacgaagaagaataaagaaaaaataacccgagcagtaagctcactatatttatattaacttaaagcacttaacgatgaaaaaagtaattatgttagcagcagtcgtagctgctttggcatcttgccagtcaaaagccaacaaagccgcagaggcagaagcagacagtctttctatagaaatggctccgatcacagaagtgaccgaagtttatgaaggtacactccctgctgccgacggtccgggtatcgactacgtattgaccctgaacgctgcaactgacggtgtagataccacgtatacactggatatgacttacctcgatgcagaaggtcagggtaagaataaaaccttctcttctaaaggaaaacaacagactatccaaaaagtagtgaacaaaaaacctaccaaagctgttaagttaactccgaatgatggtgaggctccaatgtattttgtgattgtaaatgacactaccctgcgtttggtaaacgatagcctgcaggaagctgtcagcgatctgaattatgacatcatcaaggtaaagaaataacaacctaaatcctaaccagtaaaatcatcctcgctacagctatctgtggcgaggatgatttcgttaaaagggaagtctgacacatccccctttttatttctatcccaatactccttctccctcctgcaggcgtttcagacgaagcaatgcctctatataataatagtctgcatagataatagaagcgtctatctccgaatgagccggccaatggcctgtgctatgaagcaggaaagccggattacttttaccgctctgataattgtcggaactcaggcttgtcagcatttcgatagcggcatccttgtagtgtttgcccttcccattggggagataggcagacagttcgagcagtgcggaagcaactacggcagccgccgaagcatcacgcggaacatcgggtatgcctggagcactgaaatcccaataaggtactttgtcttcgggcaagcgttccagatagacatcagctactttctgcacaaagtcaaggtatttgggatctttcgtttcacgatagactacggtgtagccataaatagcccatgcttgtccacgtgcccacattgtgctgtccgcatatccttgatgagtcactcctttaatcaggttacctgtaatagtatcatatactgctacatgatatgaggtatagtccggacggaactgacacttcatagtcttgtcggcatgagatacagcgatgtcgtataagtaaggattccccccgttctttgctgcccagaaaagcatctcaagattgatcatattgtccatgatggtattgtggggccagttgcggggttctacttcccgcggccaggacagcatcgtgccgactaccggattaaacaaagtagccaatgaatcggctgtgtccagaatcacttgtttgtaagcgggattcttggtcaggcgatatccgttgccgtagctgcaaaaaaccaaaaagcccagatcatgatcataagccggaatgcgggaaaggaactctaaggatgccgtaaacttttcggcttcttccagtatatgcttgtcttgtgtatactcataatcataccacaacactcccggccagaaaccggcacaccattcttccttcgttgctttccgacagttccaatgatgttcgtctgccatgacattacgtggcatcattgtatagtctatacccgagtctcctttcagttctaccagtgaacgttgggtctgttccgcgcaataatccagagctttattcacatccaacgtaccggaagtccgatgggcacatgcacaaaagcctagtactacaaccaaccctgctacaatcttcttcattttttcgttctatatcttcgtgttagtttcttattttttattctcacttattctttcttatcatttagttacccggaaccagtctacatccgcccatccgcgatttccgtcattaggagtgacgcagaataaaccgactttcgctcctatccactttccctgccgggcagtaaaaggttctcccgctgctgtatacttctttccatcgagactataggcaaaggtgcaaacggctcccttggcaacctttacccgtaagtaaacggtcttccactcattatcagccactcccggcattttcagatattccaccggaaaactcgccagttccttcacttgttcggggtgctgttgttccgcatctttgcatacgacttgttgcaggataaacttgtcgccggctttacggacagacaaataactataatcccatcccattactatcattccggcttgctctccatcctgcttggcggtaaacgtcagcttggtagtagccgtaaactcttcagcgggaaacttttgcagcaacagattaggcacttcccaaaagttcacgaactctttggaaaggctgcctgcatagagtcggatatatcccagatcggtcgtaaatccgtaggtatcctgtttgttggcatgccactgccactgtaatcccaagtgccgtgtatcgaactcgtcactttccggaggagtagttaccggatacatctttccgacattcggctttttataggtggtgacaggttctccgcaaccgtctttgtctttatctactccgatcacaggccattcattcacccatttcatcggattgagatgaataacacgtccgtaagccccttgatcctgaaagtggacgaaccacgattctcctgtatttgtatctacccagcccccctgatgcggaccgttgatggtggtcttcccctgcgccatcacgatctttgattcatagggaccatagatattctttgaacgaagcactagctgccaaccggtagctactccgcctgccggagcaaaaatataatagtaaccatttcgtttatagagcttcggtccttctaccgtatggttcttcccgtcatttccatcgaacaccattaccggatcggagatcacttccgttccttccgcattcagttcgcaaataaccagaatgctgttcactccgctgcggctgccggcataagcatgtatcagatatactttcccgtcctcgtcccaaagtggcgtcgggtcgatcattccttttccagctttcaccaatacgggtttgctccatgatcctttcggatctctggtctttatcatgtagattccataatccggatcgccccaataaatataaaactctcccttatgaaagcggatagcaggagcccatacacctttcccatgctgcgctttatcgaaaaactctttgggttcctgtaccggcaacgcataattcaccagcgaccagtttaccagatcacgggaatgaagtataggaagtcccggtatgcaattaaaactggaagccgtcatatagaaatcatctcctgccgcacatacgtccggatcggaatagtcggcataaagcacagggttctgataagtaccattgcctttatcagccacccaggtctgggatatttcctgtgcacccgcccaagtacagcaagccatcattcctgctataaacagaatctttttacgcatattaccttactaataatttcattcaaacatactaatcgttattcctaaaaacaggttctttttaccttatattaaaaccaatctttcaaaaactgaatcctttatctcttttcaacaatcttattactgacctatttgcttatatatacgaaggggatcaggtaaatacctaatcccctcgcaaaaatattccaaaatgtatcgtcattcccggtaatacatcaatgtgccgaaacctaactgatcaaatccaccgctattcggtccatagtttccaccacctccgtcggggcgcatttgctctgcccacttcccgctgtaaatggaagatataccttttgccttgcaatatccatagaacagttcccatgccggtcttttcgttccgcgctggtctgtagatatagttgtattggtataagacggatttgaataggaagtataggggaaagaattggaatcatatacaaaatcatcaccaactaatgttcctttattgaaggcttcatctttgatcagattgtacttgcctacatactcagccattgctactgccctataattatcaaaagcaaacaggtcctcaccgatactataagccatctgacagaatgcccccatcaatgacacacacaatgtcgcatgcccttggtcacgtcccgactcttcacactgtcccaaaatctcatcagaatccggatcctgatgcaaaaaaggaactgcatttttgatatttccagcttctttatatcttccttcttcattcttaaaatatacgatagcttgattaatcagcacattatcatcacacaatattccaatggaaagaatagatgtcatctgagccagatcccagtttagccagtaatgcatattgccctgtccgccgttatgattcttaaggaacatattggaaacactgtaaaacgtatctttcatccaagtcttgaacttctcaaaatcattcctatcccatccgttgtaatctctgagcaattccgccgcatttgcccactgatgtgcctgaataggtatcaaatataaattagggtctggaatattattagtataaccttccattctcaatatacccttgcagttcgtagcccatgcattaaacagttttacagcagcatctgcaaatacggtatttcccgacaactgatagcggagtgccagttggtaagcagccgcagcatcatacatacacgatgtgtaattagagtaatccggatatttacccgaccaattattcttatccattcgtttcaaatatccatcaagcaaagcactcgttttttctgtataagaactttgcgcataatcgcttgcttccagttgagcgtaggcatctttccagggcgatcgtgtcagattactttttacgcgatcaatatcggcctgtgtatgaagcatacaaggatgcttcaatggcaaatagtctttcttaaccatatcttcttcaggacttttcaaatcactgaatttactggtatccccattgggaatttcactactgcaggacatcataccaaatgctatcacaaagctaaagaataagcttatatatttcgttttcatatttcagatttatttgttattttctttttctacgtaaacttttaaatcttccaatgtcttgaaagtacgtacccaatataccttataagaataaggttgtacagtaacgtccgctatcttcagctggaaagtcgtcaacttatccgatggagcatccgttggaaaatagggcttagcctgcaaatcataatatataacctgcgaatcttcagccaaaactccggtcggattgttaccataatcacctttgttcgtatccaacttaagacttccgttacccggcacatccattctaaaggcaagatagcggtaagttcctatattcaagacaaccggacggtcattagaagccatctttaagtctgccctatatttgctgttcgattgcagagacatatttacagtcataccttcagcatcaaaattgaccgaagcgggcgtttgtccaaatccccatcccagtgctttcagttcatcctgattacgaacataagatagtgacaatgagactactccttcaccaactactttgacagctatcgatgctgatagtccggacaatggatcctgagctataatttcggcttcacctgcacccacagcagttaccaagccatcagcatccactgtggcaactctgtcattggtagtactccagcttaataatccaaccgatgcatcaattggttccaaaagacaatttatcagagtcttatctcctatcatcatatcatatcccggttcacttaatgtgattttatcaataggaatcacttcttttactgttactacagccgtagcagtcaattgactaccatcttgacttgaaactgaaatattagctgttccaggctttttccccgttatcgtaccatcgtccgctaccgttgcaacttcttcattatcacttttccaatcaaacacattatatccgtctgaaggagtcacattgacaatcactttcttatttgttccttcaaacagttccacgttttcaagctctatagctgtagccaccggcattacttggacttctattgttttgagagtctcaaaggcggtactctgagacaaattaatatatgcttttccgatcatcttagccgtaaccctaccgtcctgcgaaacagacaccacattttcatccgatgatgttaaagtaatctccggattcgtcacattctccggaaccggcttataatctaaaacaaaatccattcctacagctaaaggtagtgatgaacctacatttacctctatatcattcattagttgcgcctcattcatagcatcaccatattccttatcgccacatgaagctactgacagtaataagcttagcatcccaagacctactgacatccattttactgataagaaagctatatgtttcatattttttcttttttattattcatattccattattctccccaacccggattttgtcccaaagtcggatttaactgtaactgatcagaaggcaatgggtacaagtaattcttatccgcccactgacgcccagtctctacaacaacacatccttcatcattcaaactaaaggttgtattccaggactcatattcagtccccttccatttaattcccaacatagtctgcggcatctcgttctctgctgttttccaacgtttcaaatcatcaatgcgaaatccttcattaaagagttcgacagtacgttccctccgtatttccgttctcatatccaacccatgtgcctgtgtaagctcgttagtcaatgccggcatattggtatttacacgttgacgaaccagattcaaggaaatattcaagtcttcattttcaattttatcatctctctcatatatggcttctgcataattcaacaagacttccgcataacggataagcgggaaatcatatccctcttgcgtatcgggtaccacacgttcagcactccatttttggttgccataacatgtaccggaagctggatcatagactttggatgttttaagatccgtctcatcccactgccacgaagttcggccgaatttattcccccaatagcgggtacccggtttcagcaacgtataacgcatacgattatcgcgattcaaaaattcagagacctttttatcatacttctggaagcgccccgatttctcaataggcaatccatcatcacacaaataaagattggcaaacttacgagtgacccattgcacatttgccagacattcttgagttatattcttaccgattgaggccaatacctgatcatgacgacgagcaaaaatatactcatgattagaagactttttaatacctgccggatttgacttctcattttccaaaatgaacatatacttctgcgcactatcacccagtatttttgtctcactgtctgttccaaacaatcggaatgtgtatccatatttagcatcaatcacagtccgtgctgctttggcagctatgtccaacagattagcggaacgttgcgtattctgattaccattacgcgacttctgccatgttccttcataaagagccactcttgaaaggaaagcctgtgcaccttctttagaaattcgtccttcctcttcggtcgtaagttctttaaaagccggtaaattttcaacggcatgattaagatcatcgataataagatcgactacttcgctgcggtcattccgttttactttcatctcagggtctgtaatgtccaacggcttcttggtgatgataacgtctccatacaattgaagtaagtcaaaataactataagcacggaaaaaataagcctctcctatatattgctttatatcttccggcttagcataagcttcagcattctgcaacaataagttcgtgcgccggatatgcttgtagttatccgtatagttggcgtccgaagacggaattgaatttattcctcggctaaattcattgtagctctgataagtaatcaaatccgaacgtttgtcactatgtgttccatcatatacgacagaagaaaaatcacgcgtccaactataaaaggtattggcaaactgcttataatcattgacagaagtccacatattcttaccacccaactgatcctgaggttccagatccaaacaagagtggaatgtcattcctaacactatggcaaggagaattgttatttttgatcgtttcatactattctatttaaaaagttgcattaacacctaccgtgaaagttctgttaaaaggataacgtcctaaatctttagttttacgtgaagcttccggatcccagccgtctcttaacttactatgttcccataaatcagcccctgtaaagtatatccgtagtttactgatcgcatttgttttggccaaccatgaagcaggtaacgtatatcccaaagtcagattctttaaacggagataggctccattctctacagaccaagaagaacactgataattataattatttatagaaccaatgcttgtataagagggataataggcatttctgttctccgggttccatgtattaccgatggactgggttgtagtattcaagtaaatagcactcatcggtacccgccatgtttcatttccttcaccaccacggaaaactgttctgcgccccactccctgaaaaatagcagagagatcaaagcccttccattccaattcgatgttgattgaataagaaagtttcggatcatccgtccctaaatatacataatcattctgatccagtttgccatcaccgttcacatcttcgaacatgtggtctcccagacgaagattatcctgcattccaattccattgccatccaaatagtaatatttgtatttttccagttcttcttgggtctgaattttaccgacatagcgtaatccaaaatatgagttcaacgggtaaccttgctgcttaccaacaaaacctgatttcagaacggaagttgctcccaaatcaatcaatttattagtagtataagttatagtccctccaatatgatattgtacaggtcctattttgtccgaccacgtcatgtttccttcccatcctttagcctcaaactttccaagattcatcgttggggcattatctcccaacacacccggatactgggcatcaatcaacatattattatttttcttcataaataactctacagtaccagtcagtcggttattgaagaatccgaagtccagccccaagttataactatgaatacgttcccaagtacggtctgtagttacaatcttcccattcgtatcaatagtcgaaacttttccagagccaatatatgctccgctagacgaagaaaaattgtacaactgagtaccatcgtaacgatctacgccactttgattgcccaatacaccataagacagtctcagctttaagttactgaccaaagaagataacggctgcatgaagctttcctcactcaaacgccatcctccagatactccccaaaagaattgccagcgattttcgggacggaactttgaagaaccgtcatatcgcagattgccttccaccaaataacgttgtttataatcatagttcaaacgtccgaaataggacatcattgcctcatgccattttgcaggcttactgtctccatcttttatcagaacttctccggcaccatttggtatctctaaagacggattgatatcttttacagatacaaaagtatatttatactgtgtgtaattatactgtgtaccagccattgcactcagattatgtacttccgccaatgttttgtgccaattcaggtaaccggaaaccatatagtagtctgttcttgaaaaagaatcagagtatttactcttttcctgagtaggttctgtcgccaacaatttagtgcctgcataattataccaatcaatagatttctctactttctcacgtgtagcggttgaagtgttatagcccacattgacaacggcatccagatccgaatatatcttccagttcaacgattcgctgatattgatagccgaaaccttcagtttattgtctccaccttcctcagcccaccagttcaatgcacgccacgttccccatccatagggacgtccgtcgatagtagaagcaggcaaacccggttgtggggaagactgggaaagaactttccctatcatactgggagatacttgatcctgacggttataaccgatactagatgtcaacatcacagcatccgatagcttaaattggttgttcaaacgcatattgtaacgttgattgttattatttccccatttcaaggtactgttgtcatacatatatcccagtgacaaacgaaacaagtttttctctgtacctcccgagacactgaggtcatgttgtgtagaccatgaatttccccataaaatatcctgccagtcattatccataaagacaaagtcttccacatccttgaatccttcgggaatcgggtgtgcactatgactcaaatcaatgtactggttcttatacaatttggctagtctggcatagcgaatccagtttgaatcagaatagccatcattagtctgagcagtaatcactgcatccgcccattgatccaacgacatcaattccggttgaagccctaccacttttccagtaaaagaaccattatactggacaacagttttacccgcttttgccttcttcgttgtaatcaatacaacacctcccgctgctttcgatccatatatagcagccgaagcatctttcaggaagttgatagattcaatgtcatccggattcaaattacgcataccgttgataccgtcactatattccacaccatctacaataatgagtggatcagtagagttggatgaagacgctccacgaagtttcataccccaactctcatctccaggagctccggaattacgagtgataagtactccgggcacagtgccctgcattgcctgcaacgggcttgacatcgtacctttattttccagttgtttggctcctacaacggttacagcacctgttaaagattcctttttctgagtaccatatcctacaaccaccacttcgtccagtacttcagtgtcttctttcattataatcttccgcaatttaggatcggaagccggaagttccattgatttaaaaccaatatacgaaataacaatcacagcattcggagaacttacatttaaagagaaattcccatcaatatcagaaattaccccattcgtagttcccttctcgagtatacttgcaccaataacaggttctcccgtcgcatctacaacctgacctttgacttgtttttgagactgtgctatagtcctgctatcattaacatttgcataagcccatgtccgggaagccggacacagcatcaacatcagtcctaaagcaactatgaccgccttattaggttgcgaattaaaaattaatcctcttcgtttcataacattaaatttgaggtttaaaaatagtattaaattcttgttctctaaaatttgttgaggcataaagatacctctcactcagtattgattccttttccataagcaccaaaggttgtttattatatgaataattttatatacagtttcggaagaagtcacgcatatcacggcgtccgagaaaaagatggttttccactgtacggcaactcaattctaattcggaggctatctccggagaagatttatcctcaaaacgatttaacgtatagatcagccgtcgctgttcgggcatggctgccaaccgtgtccgttccatcgccatcaaatcatcagcaatgattttctcttcagtatcattggaagaagtgacagtaaaatcatagaggtaactatctatctcctgctttttataataacgacggatatagtcggtcactaaattgcgtgcgatcgtaaaaaggaagtattttactgtatccggacggagcatctgtttgtaatccatcagacgcacaaatacatcttgagttaaatcctccgcttcataacggtgagcaatccgataggtaatatagtttaagattacctgatgatattcctcgtaagaacgggtgataatgttgtcggaagtgtaagctgttgtctccataatactatctttttcggttttgaacacgatgcaaatataaaggcaattccggagaatgatttcaaaaaacaagggagatgaatctcaacgcatctaggtagactttattttatttaagcaaatgaattacaatcacttacacactttttaaacggagtctcactttataaaatgagactccgtttgggcataataagcagaccgatggttcacatctcatcaatttgagcaaagtaacctgggaagtaaaaagcctttggttattgtcacttatcaccttggcaggacaagtgtcttataattaaagcagtaagggtgataatagatggtgataataaggtgataatagaatagttcttgatttctattatcacctgtttttgacaagcgatctatttattcaattgattatcaggtgttagacagactattcaagggtaacgtctaccaatgttaaaaacaccatttttgccatgaatgtacgttgtttacgcccaatattgttctatgtaagctgcatgtattaagacaaaggctgggaagcttaacatacaaacaaggcttgactaatatattcaggtgctttcatgtattcatttcacgtacgtgaaccgttcagctcatgtacgtaagcccgatgaatcacgtacatgaaccgatggaatcacatacgtgaaacgatctcttgttactgaccgaatacattaatcttacctgcataatatcttaatgaagggagcacatttactattcatctttagccgttcctccgatactgcgaatatactcgttcggagtaactccggtacttttcttgaatgaacggaagaaagaagcacgtgaactgaagccgcatagttcggccaatgctgtcaatgtataacgggagtaatcactatcctctaccattttcttgaactgggcaacccgatactcatttataaagtcatagtatgactgattaagatattgattgagcagataggacaaggaatgggaagaagtatgcaatgcggcggcaagttctcccattttcaagtcgggattaatataaggtttttctttctccacataagcaacaagcctgtcatgaagttctttacattcggcttcgctcatacggttggccttatatttttcttctgcaggatgtggttccgccgtcttttcttcttcctcttcttcttcggatgagatctcgtgtacttccgtgaccaatggagcagatttccgcacataatatctcaccagaacaacgatcagaataatcgatatagcgagaatcacccatccccaccaaggaatcatcggctgcacagtcaccttataaatggccattgattgttcattgcccggaatacgtacacagaatgtgtatgtcccggaagaaagcccataatacgatacttcactctgtgctgtcagcaacttccagtcactgtccgctccctccagtttatactcatataacaaggcagaaggtaatccatatgcaaaatcggtaaaacaaaaagtaagattgttctgattatacttcaaagacgatttattgatagaaactccattagccagaatatccgtaaagacaatcggacggacctttccacgtacctcatctacctgtttcggatctacatagatcaaccccttggtattgccaaaccacaacagtcctctttcatctttataagccgctccgttagtgaaagtcggtcccggcactccgtcattgaaggtgaaggagtcatactcttctccttcttccttaatacgcaacaatccatcgttgcaacctacccacagccagccttgattatcttctgttattgacatcagcgagttatcgggaagcgtagaaagtactgattgattgcggaaatggtccatcgttaaggtagaagtaaacaggctgcctttctcacggataaagtaaaggttatgttctgcatcttcataaatagtacgtactttatctttgtgtacaaatccttccggaaatacattggaacgaaggctttgtgaggccggatcatagatgcacataccggtttctgtagcaatccatccttttccggtagagtcaaaacttacttcatacacatttccttcgggcaactgagagttggtgctggtgaagtttttgatttgctttgtctgcccgttgtaacagaatagtccctgcgaggtgccaatccaaagatttcccctgttatccggttttacacagaagatatgtcctttctggaagagttccgtatcaccttgtgtaaagtatttgagagataacgtctgcggatttaataccatcataccaccgccatacgtaccgatataatattcaccttcatagaagcaaatggtaaggatcagatcggacgtaagaaccggtttcacgaaacttttcactatgccggtagcttcgttaatatagaacaatccgtcacgcgaaccaatcactttctccggtccccggtttacgaacgaacgaattgataaattggcagagttaaactgaggaagataagcgtacgtacggaacagtccgttttgatacagtgaataatccaatccggcttggaaatgtcctacccagactgcacccctgtcatccaccagtagtgagtagatagaattactgcgaatcccttctttatcattcacatcatggaaaaagcggcgaaccactttccggtctttgtgagaaaggaaatgaaccccatttccatctgtagcgatgtacaccgtctcctttccatcaccggaaatatcagatatcacatcacatcccaaagaaaccgtatgggcaaatgtctgtttcgggatatcgaaacagacgactccctgactcattgtacccagatacagcgtttcacctatgcgggtcagacaacggaaataatcggcttcgggaacattctctctgaaatgccaggaattgatctgaccatctttcagcgaataagaaaataacccttgcactgttgccaaccaaaggacactcttatcttcattcaggcagaggtccatgatccggttacaggctgccagcatatttttatcggtctgtacctgaagcaactgaccgtctttctgaataaacagtcctctctccgtacctatataaagtacatctccatctgccaacaaagcattgacggcacagtcgatcttctcgggaacgattctctgcaattcactaccggagcgattcagccgccagagtccgattccatttccgatccatagttgcttgttatcggtttctgtaatacagttcacccgtttctttcttcccgaatctactccgcggaattcgaaatgcttcaccttcacaccgtcaaaacggtcgaggccgttgtctgtccccaaccagatgaaaccttccgagtctttataaatagcattcaccaacaaaccggaaaggccgtcggacataacgacattacgaaacatatagggttgtgcctgcaagttttccccgcaaacccaacacattattataagaaccaaatatttaatcgtgcttttcacctgccaacgggctttatcatattaaacatgtgacaaacatacacaaaaatctccaaaagagagcggttccttatctaaaaagtcgcctctccatatttgctgatgctaatagacaaatacgaagaggcggaagtatttactcaatgcacccgaataatttattcgtgcctgttcattaaattaaatcaatcttgtaaatcccaatacactacataacgctggtgatgcaaatcataaagcggacggatcacatctccttgctccgtagtaaatttcaagtcttttcccacacggtgcaatgttcgttcggggtgtttcacgtctattttcaatgatgtacgcagatcggcaggaacatgaaaattataagtataataatcgttgtaaagagcaggatcagagaagggagcaggtgcctgcattccttccgttccccgttctccggcaagtactaacggtccatacagcaaagctactttattcggattatcgggagtagcttccagttcgatctgcatgggataagtggccgcaatacggtcaccatctttccattcacgggtaatagcaatataagaacccggtttctgtttcactgacacctttttaccattcacaagtaccttcacatttttactccatgagggatatctcaaataaatagtagtatgccttggcttttctgcacgaagagtgagccgagtagtctcttccttcggaaaatcggtttcctgaagaagcgtcagtcctttttctttccaagtcacttgggaaggaataaacagattcacatagatgcctttatcattatggtaatagatggcttctccatatttggcatgattctcaaatccactgcctacacaacaccagaaagaattttctttggtgctatacagtttatgagagccggaaagtaacggaaggaaataagttaccatccctgtttccgggtcttgctgtccaaggatatgattgtataatgctctctcgtagtaatcggcaatagaagaatcaccggtccagcagaaaagatggcgactaagtttcaacatattgtaggtgcaacatgtttcaccggtataaccagtcaagtgtttagagcatttcttcgggtcgaaaaaatgctctttatcactgctgcatcccggagcaaaggtgtgatggtcaatcatggtatgccagaaaaactctgaaagttttttactcgtctcattctgtgtcaattcatagttgcgagcttctgcaattactttcgggataaatgtatttgtatgtttggttcccaaatcatcccgaagttctttcagtgggtcgatcacgtcattatgatagaaatattccgccaaccaacgataacgctcgtcgcctgtgatggcatataaattataaaatgattcgttgattcccccgaactcattacgtatcattaaccggcgtgtctcttcactaagcggtttcagtttgttataagcccagtcgcccattttggtcaccacactcaaagcctgctgattatctgcatataagtattggtctatcagaccggaataaagtttatgcaaggtataccaaggtgcccagacactctttccctgaatattgcggttgatcagttcttcgggatatgcgctcaaatatcctcctttaagtgcattctgcacttcggtcaatccatttacaaggctatctcctttaagtttgaaaatctcacttccggtagcagcgtacatcaatgcgtaagctgaaagcaaatgtccggtagtatgtccgcgaagttcgcagtccagagattcccagccaccgagtttttttacagtcatatagccgccttcacgacctgcaaagacaccggcattggtccggaagctatgtaacagacgattcacatcaagagaagtcatccatgccgaatcccgcaacatattatcacgaaaacgactcgctaagaggcggacatcctttaaatcaaaactctgtacccgaattggagccactgtctcttttttcatttttccctgatgctgaccggggtatacagactgggcggacatcatagtcgacactgccaaccatgctattacaactagatttttcttattcataatcattctttatatccttttcaataagatacgaataagcgctgttcaacactcaatacaatgaaattaattctgattgatcgttccgtaagctttcgttttattccatattattgataaataaagaaacttcgttctatcggctctgctgtctgtacctttcccgccagcccatattgccaggcaactactgtcaccttcaacggatatttactgcgaggaggtatcggagtaaatacaagtttgtttccgtcgatttccgcagggccttctttcacataataatatacaggcagtccgcaatcggaagtagcccgaagagtgacggactccacccctgccttcacatccccaatgccagggaaaagtatatactgtcgtttcccctccgtgttacggtaaggaatccggaaactaagttcctgcactgtacttttatattgattatcaccgtcatgactcgccaagaggcagatgtctcctgtgcgacgcttattatacattcccatgcggtagaaacgaacagtaaaagtagtatcattcaccttctgtaccggtccgcagatgcgggttatttcgggaaaggtcgatgaatgttcgtcggagatggttgtatgcagactatccgtaaatacagctttcagatgaaaagtaagtccatcttcctccggcaggaaacgggcggcaactttcacatgagacttcgggtgatatgcaagaaggctgttctcttgtacaaaaccaagatattgcggttttttccctctttcctgacgataacgttcttctgtcatgtcagccatctctttatcgaaataccagaaggcatcatgcggatcgcctttgtattgtttgaagggagctgctttagcacgtctcttttggtcaggatgccaacgctcggcaagccatccgttttccggattcaatttcttcagcatcacgggcttatctacatcatacgtttccggcaatcggtactccatggctttcttcagaaacaatgcaaggtatactgctgtacggtctgcaatatcaaaatgtccgcgcccagtatcacaaagaaacgagatgcaactccggggatacatcaggcgaaacgccaatgccggatttacacgatcttcccaccattcatattctccttcgatcatcaagccgggaatgccgtcaatagtacgtttcccccactccatgttatcacggccatatccggtaagattagtacgcggtgcgtctccatgaaaggatatgacagccaatgtccgttcgggattccatgctgcaaaattccaaggataagttgccatcgccgaatgtccgaaaggaacaatcggaacgtattttaattcattgtaaccgctgatagcggcaaagtcctccaacatctgctcaaatgccctctgacttccggcagatacatcccatttctggtcccagcccggagtaatccagatcaagcccatacccatttcggacattttctcccgaaacagaagattctcaaacagggtttcctctgtcatattgtgagtacctatcatcacacctcttacctgggcacaatcggaaggtatccacagaaatgcctgtggatgatcatcagtttcgttagaaataatgccgggtatttgtacagaccactgccattccgccgctatacattccggccataacataaacactaatattccaaatactaaaaatcgaagtagtttcatgttccattcatttatcgttattttatgtaatacgtaacgaaaccaaagtatactcaaccgaaaaatataaaaaaactattattataggaactctttcatcgacaatttcacaaaaacgtcgtatctttattctcaattaagaaaggagtgatatggatttacgtacagcaaacgtaactagatatattcttcccctgcgggaaggcggatcattgccggctttggctgaagctgacgatgagttcaaatatgtcgtaaaattcagaggagcaggccacggaaccaaagcccttatcgctgaattgatcggaggagaaatagcccgtactctgggcttcagagtaccggagatcatcttcctgaatttagatgaagctttcggccgaacggaagcagatgaagagatacaggatttactgcaatggagccgtggattgaatatcggtttgcatttcttgtccggagcgttgaccttcgatcctgtcgtacatcaagtggatggtaaaaccgcctcacagattgtgtggatggatgcttttctgacaaatgtggaccgtaccatcaagaataccaatatgctgatgtggcataaagaattatggctgatcgatcatggagcttccctttacttccaacatagctggaccaactggcagaaacaggcactcaccccattcgtgcagataaaagatcatgttttattgccatttgccgaccaactgaaagaaacagatatggcattcagacagttactaacctccgataagatatgggaaatagtcaataccgtccccgacgactggttgaactggacggaaggacaggaaactccacaagacctgagagatatttatattcaatttttagaggaaaggatcaagcattccgaactatttgtaaatgaagcgcaacatgcaagaaaggcacttatatgaatacgcaaccattcgtttcgttcccaaagtagaacgtgaagaatttatcaatgtaggtattgtactgttctccaaacgatgcaaatacctcaaatcactttatacgatagatgagaataaactgaaactgttttcttccgaactggatatgaattgtctgaaagaaggactgcatgtcttcgacaggatttgttcgggtagtaaggaagggggaatgatagcaagcatggatgtccccgatcgtttccggtggctgaccgctgtaaaaagctcatgtatacaagtatcccgcccgcatcccggattttccgaggatttggatgctaccttggagcgtttgttcaaagaattagtgctttaaatgatcaatcatggaatttatcaagataacagagcaaccatcgctctatgatgacctcgacaagaagtcggtaaaagagattctggaagatatcaatactgaagaccataaagtagcggatgccgtgcagaaagcaatcccacaaatagagaaactggtcacattaattattccccgagtaaaaaaaggtgggagaatattctatatgggggccggaacaagcggacgtttaggtgtactcgacgcttccgaaatacctccgactttcggtatgcctcccaccgtagttatcggactaatcgccggaggagataccgccttgcgcaatcccgtcgagaatgcggaagatgatatgtcccgcggatgggaagagttattgcagcatcatatcaatagtgaagatacagtcatcggaattgcagcatccggcaccactccttatgtgatcggagccatgcgcacagcacgggaacacggaatactgaccggctgcattaccagtaatccaaattcgccgatggctaccgaagctgatgtaccgatagaagtgattgtcggtccggagtatgtgacaggaagttctcggatgaaatcgggtactgctcaaaagatgattctgaatatgatcagcactactatcatgattgaactgggacgcgtgcaaggaaataaaatggtcaatatgcaattgagtaaccaaaaactcattgatcggggaacgcgcatgatcattgaagaactccatctggactacgaaaaggctgaggcacttctgttgctacacggttcggttaagtctgcgatagaggcctatcgcagacacaactctactcagcaagagtaaaatgcagtgcagcaccaccggaggactttaacttcaaagttagcttatctccggcttttatcttcttatgagtagtacgaacctttgtacgtgtattcaacttgtcgtcatcttcatacaagttgactatatacttcgttcccggtttcaaaaaatccgtggttaacgtaatggtacgcgcttctgtatttgtcattgctcccacaaaccattcttttccggaacgacgagcctgcacaatatattcacctatttctccatctaatgcacgactttcatcccaaacagtcgggatggctttccagaactccagttcctcctcacctttatacatagcaggattatcataccaaaacataaattgcaaaggactgtaatatacggctgccattgccaattgatgtgctttggtgtttttcacgcgactattaaaataacagagtgtataatctcctgcgcctgccagaaaacgagtataagggagaatggtattgtgtgtcgcatccggcatctcttcatttccacggataccttcttgcgtcatcaaattgggataggtacgactgaaaccggttggacgatattcatcatgaatatccaccatcatttcatattccgcacatttacggactgcatcatgtaaccacgtactccaatgctgattacctatctgtacaaaaccgaatttaattcctttcaatccccattttttatacaatggcaataaagaatctagctgttgaaccaaagcacgttgattgacatagaccattaatccaatgcctctagattctgcatatttacataaagcagaaatatcaagatctttatccggagaaaccgtagtagcatccgaactcattttcatttccgggccataccatcctgcatccatatgtacatattgaatgccacgttccgctgcaaaatcaatggctgcttttactttctcctgttttaagtctccagaacggaatactttcccaggcttaatccaagaaatatctgatatccgacaaggagtatttaaattcaaagccaaatcattatgattgatcaaatcgaccggacgttcggcagccataatgacacgccaaggggtactgtagggagaaataatgtcaacgctgctatacaagctagtttccagtgttgaaggcttctctgcagacaaacggaattttccacgagcataatccaccatctccgcttccagtaatgcaacagtcaatccatctggcagtttcatagtcaaagggcgttcactttcctcttttccccaccctgacaggggacgaagctcataaggaccttgtgcccaacgttcatagtaagccattgtaccttcaggcattgtgaaacttgtccgttcacctgtaatatgtaaaaatagcccattggtcgtttccggaaaatgataacggaatgccactccttcgttataggcacggacgataatattcataaagtagtttttacgtttgtcgtaaccgccttcagtcatcccttgtccctcacctttacgaaactttaaagtcatttcattataacagtcccgaacttcggcacgttctccatatacaggtttccatgttgcatcgtttttccgatgatcagtatccgttaatttcagattctcgcaccaaaaatggcaagtatcgttcggtactcccaatgccgattcaaacaattgattctctatctgtacaccgagttcaccctcctccactacaggacgattcttatatatcagcgtataatacatccgtgcattatcctctccgaacgaacgctggtaaaaggtgaaccgatacgctccgtctggggaagtcagttcccggtgggtttctgtcatcacattctgtgcctttgtcagtgtcggtattaccaacagtaaaagcaagatacttttcttcattctatttaaattcatgtttatccgtttttccaatatatacgaacgaattaattattatactcaatctgtctcccaaagaaacactacttctcaattctttttataaaagtctcttttctttcatacatttctgcaaatataaacaaacatcttgcaaaaataagcacaacatcacattcaaaaagcagctacttttgcatcaattcatataaataataaataaaaccatgaacgaattatttagtattgccggtaaggtagctgtaattaccggagcaggtggtgtgttgggaggaaatatcgcccagcactttgtacagcagggagcaaaagttgtagctatcgacatccgtcaggaacaactggacaaccgtgtagcagaacttaaacaatatggtcaggatgttatcggtattattggagacgtgctggacatcgccagtctggaaaaagtagcggaagagattgttgcccaatggggacagattgatattctgttgaatattgccggaggcaacatgccgggagccactcttgaatcggatcagaacttctatgatatggacatttcctgttgggagaaagtgaccagtctgaatatgaacggtacagtctatccgtctatgatctttggtaaagtgatggcagagcagaaaaaaggttgcattatcaatgtgtcttctatggctgcttatagtgccatcacccgtgtgccggggtattcggctgcaaaaacagctgtagctaactttacacaatggcttgccagtgagatggctctgaaatatggtgacggcatccgtgtaaatgccattgctcccggtttctttatcggcgatcagaaccgtcgcgtacttatcaatccggatggctcgctgactgacagaagcaaaaaggttttagccaagacaccgatgaaccgttttggtgatattaaagaattgaacggtgccgtacaatttttgtgtagcgaagctgccagttttgtaaccggtgcaatgttgcctatcgacggtggattcagtgcattcagcggcgtataaagagaagaaactatgatggaaaaaacatggagatggtttggcaagaaagacaagattaccttgccaatgctccggcaaataggtgtggaagggattgttacagctttgcacgacataccgaacggagaaatatggacaatagaagcgattaatgctctgaaatcctatatagaatcatacggactgcgctggtctgtagtagaaagtttgcccgtatgcgaagcgatcaaatatggtgggacagaacgtgaacagttgatagagaactacaaagtaagccttaccaatctaggtaaatgtggaataaaaactgtttgctataactttatgccagtcatcgactggatacgtacagacttgcagtacctctgccccgacggtactagctcattgtattatgaccgtatccgtttcgcctatttcgacatgaagatactggaacgggaaggggctgaaaaggattatacggaagaagaacttcataaagtttccgaactggatcaagtgatcaccgaaaaagagaaggatgatctgattgataccattatcgttaagacacaaggatttgtcaatgggaacatcaaagaaggagacaaagaaccggtcgtccttttcaaacggttgttaactttgtacaaagatattaaccgtgacatcctgcgagaaaatatgtgtcactttctttctgccattatgccggtttgcgaagaatacggagtgaatatgtgcgtgcatcccgacgatcctccattccaggttcttggtcttcctcgtatcgtcaccaatgaagaagatatagcctggttcctgaatgcagtagacaatccgcacaacggactgacattctgtgcaggttccttgagtgccggcgaacacaatgatacccgcgaattggcaaagaagtttgctaaacgtacgcactttatacacctacgcagcacagccgccatgccgggtggaaacttcattgaaagttctcacctggcaggaagaggacatatcattgaccttatccgaatctttgagaaagaaaatccgggattacctatgcgcattgatcacgggagaatgatgctgggagatgaagacaaggggtataatccaggctattctttttatggacgtatgctggcactggcgcaagtagagggtatgatgacggtagtggatgatgaaataaaacgtcagatgaaattatgattctctttcaccagacattgatgcaaaaaagaagggagaagtcatatttaacatctcccttctttttatctatcatagcaataatcaatttctctttgaaacgatttatttcttttgtccttcttggaaatccggtatacgttttacatccgcacctttcattacaccttttttaattgcttcattggtttctgaaatttctttcttaacacgcttataatattctttagtcagtcctttctccacagcttcagactctgtagccgcccagaaatactggtaatccatcagcatcaagtcaggagcaaccaccttaaagaaaatactatctccttcaaatttttcacgtaaatcacctaaataaatagtgtctgccggatttacttcttgtgtacttgcatttttttgtgaactactgctaccacaagaggctaacaataagcctccaaataacgaaataaaaattaataatttcatatatctatcatttataatataaaacatgctcaacggttcaattatcaggatcagaatatcatcctgtaacagagtgcacaaaaatagtaatttataatatcataatgatcatttttctgttctttttctatattttcctacaaattacttgagtaatacgttaattactccctaaaaatgcttcacacatacttatatcatatcaccactttatctatccctttctactttttccaatcggaaagcactgagacataacttttgtccggccttgtcaacacgtaaacgcaatacacaggcaccagccgaaagtgaaagttcgccaagttttgtttctttccactttttagaagaagggatcgaagacgagatttctaatccctgatcagaggccattgctacatgtgaagaggaatttgccgaataagtaagataaacagcgtaagctccacttttagggatattaacagtataattcatccactcgccgtcttctacctgaaccactacgtatttattatctattttctgtaattcaactgctccatccggacgatactcatttccacgtactgtccctatattatgataggtatgcccttcaggattttctgatatacaataataatcataatcagcagccaaaattgtactgggcaattgatgcaaaccggaaactcgcttacctgtagaaaaagtaaccggatcacctgccatccaaggggtcagtcgcttagttaaagtcccccaaccagtccactcataaaaccaattcggggctactccccaattctcacatccataacgttctatcatataatcacgataacgctgtaaccaggtatatttttcagccggtaatccactacgcaccgcataatgtgccaatgccatttctctggttcctcctgtcccggcaacatctccccgtccatgagaggagatattcacagactcccaacgtccgctacgactttttatctggagatatttcccgttatcaaatgtgacttcattcatatcctttgttaatcctgttggctcccaaggtgtttcctgttttttgtaagattgaatacttgacaggttataacgataactccattctagcccgagcaataaacgattgtccaaactactatataaagaatccccctgattccatgccatttctgcaatagcaacataattgtgcaacccggctaatacatgtccctgatcacgactggattcctgacactgaccattaggataaatataatattgaagctgttcgtcataaccataatcctgaatatcattcttccgttgtaacaatttataatcaatcatagtaggagaaacatgaatgggttgatcgctggaaatagccggtcctgaaggatatggcaaatcatctttacgatgtttcattcccagtaaatagcgataagcacggtcatacattatctcattatcaagatagatagccattgccatcatactgcgtgctgcaaacaatccttgattaccgaaacgcgctgcatcaaaattatagatattccaataaaaagttactccattttttgtatcatccagataattagcatatttagcagaataattttccgtattactataccccggataaaccagcatatctttgaaacgttgctgatcttgccgtgtccatccagaataatctctcatcatttcagccgcatcaatcaacaaataaattttcccattatccaacggtcctgtaccacggctactagtattagtataataagaatttgcattcaaatattctacagccttacgtgcataggcttcttctcctgtcaagtgccaaagaagagctaaatcatgagcacgacgcccatccaccccgattgtagcattaaatcgcccttcctttatttgctctccacgattcaccacaggtgcatcaagtgatgaataagaagactccttcaatttcaaaaaggtagaataataaggttcttgtctggcttctaccattgctttcatacgatcgaggtcaccttgcgtataagtaatacccggatgaacaaaacgacgttgtgactgagctacatcacttgtaaaaacaatattttccacatgaggtcctacatatatgcgtgccatatctgaagtcttataccaccgaggtttgtccggcatattatcatcaatcaattttccatttattttcaaattttcaaaacgtatgttctttaccttacgtttttcatcatatccttcaataatagaaagttccgcattctctccggtataggatatattcttaaacaatacgttctcaattcctcttccgggagcagtacagtatttttcattataaaagatacgtaaattgacaagttgcccctgacggaaattctcaacacggatgtcctcaaaatgaacattgcgtattaaattgttatcacctgcattaatagccatacatccttgataatcgacttgtttctctctatgatccaatatatcaatattaatataattcagatcttccaaaacttcgggagctttagaattaccatgaattccaataaaaataggatgggctacatctgcccaaagagtggaattctgcattgttatattccgacaacctccttcaaatcccaaacgagtgccataaacagttgtacaatcatctgagttacggcagaagacaccatcaaataatacgttattgctcgcaaaaacattcatgccatctccccacccataataactaatacttttgacattacggatagtaacattttccgaccctcctgtcgcacattgagtagcaacaattccttctacatagacatctcgggaattcgcaatacgaatacctccttttatagaatgatcgataattcctcttcctagcaattttacatcatgtacgttttcgattaggacacgccccattaaaacagctcctcctgccagatacacagtcttaccggatggcactctcaattccccatttttaactgtatgtattccaggaccaaagtaaattacttccggattatctttgtccggaatcgttctttccggagatcctgtaaataagtgaaaattatgaaaaatatccccatttacttctactgacaaatttcgaggatgctctaatgtaaaagttactgtattaccatcgatctgaaatgggatatcatacgagagaggacggacttttgccgtctgtacttctcccaaattataggttacggctacttccacttttcctgtaaaatcaaaaattgccatcgaagcattttctacataatgtcgtgtatctcttacctcatccaccttaatcagataagaagataaggtatgccagactccatcttgcaaacggaccttaaccgtaaaatcactatttaaagcaactcctgcgggagccttccaagttgcaagtgtgtctttagcaaagatacaagttgcaccacctaataatgcagctaataataagaaccaatatttcttcatgatattatcgaataaaattcttttatagtattacgaacaataaagacgattcacctattctctatcaaagatatttatgaaaactcgcaaaacaacaatcgttcaattaaaacaatgatatgtttattcatctaacaatgattcttattgtacagccaataacgtcaattcggtggttattccagattgcaccgcttttccgtcaatcaccatcttacagggggcagaagaaagaatataccattttccctgcttcttttcgagcagcacattagcagcctccgaagtctggatactgataccggatgcaatcagttgcgttccgttccctataaacagcgtccggtttcccgcatattcgttactgattacggcatagtccgctttcactttcattccctgataggttgcggtctgcgacgaatccgtcaaagagaaaatatggtcagtacgcccgtttttactttccacacagataccggcaaagtctttcaagccgggctcttccgcatcaaagtaagagactgactgaatagccgaaggctctttctgcgtacttggttcataaacagcaacaaaaggacgattccatgcttctccatgctgccgggcaacgaaggtgagcgtaggctgttcctttatattataaggcatatggggagtccggctcaatccttcggtcatcggtgacagtgcggtgaacacttcccgttccggttctcctttcatccagagattcatggaaatatcatctccgcctttatccttcatatcgatggtaaaagtcactttcacatcctgaccggtggtagccactttcttatcatataagtaggaataagcataaagatgggcacctgcaaaagctagctcttcggtaggctgcaaattcaagtccgtaccatcggcagccgtaagtgtcattgtctgacctagattatggtagaaataatcgtgcattttatcgcctccccgttctttccggctgcggaatacatccacataataccctgtctccggaccggtagtaacaatgcccatcagtcgagtctgatccgccctgctctccggctcacggaaagctacctgactataggtgacggaagtaaatcctttacccggttccgccgaagccggaaaacaggaaagcaaatcgaaagaatgattacttttcatcaccggataactggaaatgccatctacacaaaccgtattatgactggggaattgagagtaatattccgcatagtccagaccgctatacagaaaaagtccgatacccgcatccggtcccagcacatatccttttccataaagctccatcgaaataccattcgcgtgcatatgattgccttcactagcattgagagaaatcatcagactgttgcgcggatgcatcccgttgcgctgtaccagccacgatacgttgggggcatagaacagaggagatacataatcctcgattttccccgcctccaccttcgggtccaacactaacggcttgtcctcaaagaaggagttgacagaggcccgtacattcttcttgccacttttttcgctaccttcctccggattcagacatttcagcaaagcggtgaagtaacgttcctgctctttctttccgtttgcctgcgcattctgtatcatccggataaagaagttcgtacttaagtaacttggatgcgtatctccgaaaccacagatcatccggttcggaaaaagatactgcggagtagtcgctactgcttttgccagcacaggcattgcctttaccaagtcatattgcagattgtggtcaaactgatgggtgaagttcgcgtagtcattgatgactacactgctgtatcccggacattccgcccatatacccgtttcggagtcaaagccgtaatcggccagcttggtcagactccactggcggatgctcgaacggttcataacgtagtcaatatagtattcgcgtcctttcccgtccgcatattctttattatcttccagcaccagtcccacgttcatgatatatcgtgcctgcaataaatcccagttattatgggggactccgttggcgatgatattatccgcccatttcttcaatgcgccggcataaatcatcatcttatccggatagttggattgcagataatgatagaggaagtcatacaaagggacaacgatatgcaaagcatcctcatggatcacttcaaaagaagtcagccccaccagtgtctgctgatgcccgtgattcaggtcaacaggaacatttctgtaataaattcccgtcatataagtatcgaaaacgccggcagccagtcgggcatacttttcctctcccgtcatccaatagaggaaagcggcgtcacgggcaattcccagaatctcacagttcagactttcaatattgcgtccggtcttggacggatgcacactctccagcggacgacctttcagggcattgttgcagaaagtcacgtttccttccgcactatcgtcataaggtactacatcttccagcttaggtcgaccgtgcgtagcggccgtccctcgtgttccggtatagcgaaccgtcggagcaggtgccttcgcgcctccggcatggtcgaacacctcacctttcacgtacacttccgttgcatgcgacttccagtacatggccaaacgggataataaccagtccggctgactttccgtacgtcgcgtatatacttccgtccgttctttcagcttgttaaagacatcttgtgcccatgcttccttcttgatcaacttccatgtttctttttttccttccggggtagtcagtactctcggatgatcctgcggcatcttctccggcaacggaatctcctgcccgtgcgcattcaggaaaaaaagcacacacaatcctaacaaaattcgtctcatacttccatttcttatttacgtttgctacgtatttaatacgaaaataaggaataatttacctaactggtatcagaaaacccgtttttattttcaccggtacggactgccttcatactccggacattcaagtatactcaaaaagatagcctgcaagcataccacttacaggctatcacaatccccttttttccctttgtatcagggaggcaacttacgtttccccgtccccgccggaactcttgctgtacatccttgccatcaagctatataaaactcatacaaggagcattttcccattcagatacagtaccggcaggtccccataagtcactccacaatgttcttgcgaatctccccaactattgttggattcatatgggtattcgccctttttcgatgcgaagataatttttttatgctactattatagttaacaccgtctattaaaagtgttaaaaataaagatttcataccatacttccgcaagccgacaccaaagaagaatatttattttctctaaacaaagcgctaattccgaacaaagaattatatttgcagaaatctaacaattctgatacttatgaaaatactatctatccatgatttgcaaataatcaggaagagagcggagcaccatctttcattgcgcgaagaaagtaatgaaaaggtttccgaaaaatgttgcgggctggcgtccggaacaacacacctccagattcttatttgcggaggtaccggttgtaaagcctcttccagtcagggcatcactgaaaatcttcaaaaagccatcgaaagaaacgggattaccgacaaagtagacgtcatcacagtaggctgcttcggcttctgcgaaaagggccccatcgtaaagatcattcctgacaatacgttctatacccaagtcactcccgaagatgcggaggaaatcatcagcgaacacatcatcggaggacgaagaatcgaacggctgctctacatagacccgaagaccgaacaaactgtcagtgactccaaacacatggacttctaccggaaacaactccgcatcgccttgcgcaactgcggattcatcgactccgaaaatatagaagaatacatcgcccgtgaaggatacttcgcactggccgactgccttctcaacaaacagcctgccgacgtcatcgacatcatcaaacgctccggactgcggggacgtggcggtggcggtttccccaccggcttgaaatgggaatttgccagtaagcaggtatcgaacgtaaagtacgttgtctgcaacgccgacgaaggcgaccccggcgccttcatggaccgctccatcatggaaggcgacccgcactctattgtagaagcgatgtgcatctgcggttactccatcggttcctccaaaggactggtctacatccgcgccgaatatccgctggccatcaaccgcctcaaaaaagcgattgagcaagcccgtgaatacggattactgggggaccacatcctggggacagatttcagcttcgacatagagatccgttacggagcaggcgcattcgtctgcggcgaggaaaccgccctcatccactcgatggaaggaaaacggggagagccgaccctgaaacctcctttccccgccgaatccggttatctgggcaaaccgaccaatgtgaacaatgtggaaaccctcgccaatattcccattatcctgaccaaaggcgccgaatggttcgcctccatcggaacagaacgctccaaaggcaccaaagtcttcgctcttgccggaaagatcaacaatgtcggactgatcgaagtaccgatgggaactaccctgcgggaagtaatctacgaaatcggcggaggcatcaagggaggaaagaaattcaaagccgtacagacaggcggtccgtcagggggctgtctgacggagaaacatctggatactcccattgacttcgacaacctgctggcagccggttccatgatgggatcgggaggcatgatcgtgatggacgaagatgactgtatggtatccgtcgcccgtttctatctcgactttaccgtcgaagaatcctgcggtaaatgtaccccatgccgtatcggcaacaaacgcctgctggaactgctgaacaagataacggaaggacggggcacggaaaaagacctggacacgcttgccaccctcggacgggtgataaaagacacggcactctgcggactgggacagacgtccccgaatccggtgttgtctaccctcgacaacttccgtgacgaatatctggaacatgtcagagacaagacctgccgcgccaaacaatgcaagtccctgctgacctataccattaatccggaactttgtatcggttgccacctgtgtgccaagaattgtccggcggatgccatcagcggcttggtacgcaaacctcatgtcatccaccccgagaaatgtatcaagtgcggcatgtgtatggcacgctgtaaattcaaagctattcttgtctgttaaaatctactgctatggaagaaaaacaaattaccctccagatagacggtcactttatcaccgtacccgaaggaagcacgatcctcgaagccgcctgcaaaatcggcatcaacatacctacgctgtgtcacatcgacctgaaaggaacctgtatcaagaacaatcccgcttcctgccgcatctgtgtagtcgaagtggcaggacgccgcaatctggctcccgcctgcgctacccgttgcacggaagggatggtggtgaaaaccagtaccctacgcgtgatgaacgcccggaaagtggtagccgaactgatcctgtccgatcatcccaacgactgtctcacctgtcccaaatgcggcaactgtgaactccagacactggcactgcgtttcaacatccgtgaaatgccgttcaacggcggcgaactttctccccgcaaacgggaagtgacctcctccattgtgcgcaacatggacaagtgtatcttctgccgccgatgcgaaagcgtctgcaacgatgtacagacagtcggcgcactgggagccatccgccgcggattcaacacaacgatagcccctgccttcgacagaatgatgaaagacagcgaatgtacctactgcggtcaatgcgtagccgtatgtccggtaggcgcactgaccgaacgggattacaccaaccgccttctggacgatttggccgaccccgataagatcgtaattgtccagactgcccccgccgtacgtgccgccctgggagaagaattcggcttgcctcccggcacactggtaaccggaaaaatggtttacgccctccgcgaactgggtttcgactatgtattcgataccgactttgccgccgacctcaccatcatggaagaaggttccgaaatcctgaaccgactgacacgctatctggacggagataaatccgtccggcttccgatcctgacttcctgctgcccggcttgggtaaacttcttcgagcaccacttcccggatatgctggatatcccttctaccgcccgttctccgcaacagatgttcggctccatcgccaagtcttactgggcagagaaaatgggaattccccgcgaaaagctggtagtcgtctccatcatgccctgcctagccaagaaatatgaatgtgaccgcgacgagttcaaagtaaacggtgtccccgacgtcgattactccatctccacccgcgaactggcacgcctgataaagcgagccaacatcggctttaccctcgtgctggacagcccgttcgacaaccctatgggagaatcgaccggcgccggtgtcatcttcggtacgacgggtggtgtcatggaagccgccctgcgctccgtttatgaaatctacaccggacagccgctgaagaatgtcaactttgaacaggtacgcggactgagcggtgtccggcgcgccaccatcgacctgaacggatttgaactgaaagtaggcatcgcacacggactaggcaacgcaaggcacttactagaagatatacgaaacggacataatgaatatcatgtcatcgaaatcatggcatgccccggcggctgcatcggaggtggcgggcaaccgttgcatcacggcaactcggacgttctctacgcccgtgccaacgccctttaccgggaagatgccaacaaacctttgcgcaaatctcacgacaacccgtatattcagaaactgtatgaagaatacctcggcaaaccgctgggtgagaaatcggaaatgctcttgcacacgcattatttcaacaaatcgattgattaactttaaacaagtactattatgtcagatatcaaactagcctgcgatgtggtggaacaagtcaagacgatttgcgacaagcacgggaacaatgcgggcgaattaatcaatattttgcatgaagcgcaacatctgcacggctatctgcccgaagagatgcaacggatcatagcctccaaactcagaatccccgtgtcgaaagtctacggagttgtgacattctacaccttctttacgatgactcccaaaggaaagcatccgatttccgtctgcatgggcacggcgtgctacgtacgtggttcggagaagttgctggaagagttcaagcgggtactcggcatcgaagtcggagaaaccacccccgacggaaagtattcgctggattgcctgcgctgcgtaggcgcctgcggactggctccggtagtgatgatcggcgaaaaggtgtacggacgactgcaaccggtggatgtaaagaagattatcgaggaactggaataagtctcccccgcccttcaaaagaggatgtgacgtatcgggtatccgatatgtcacgcatcttctttggggtcatatccccacttcacataaaccgctccccaggcaaatcccgcaccgaatgcggtaaatatcagattatcgcctttcttcagttttttctcaaaatcccagatgcagagcggaagcgtgccggcactggtgttgccataacgttcgatgttgaccatcactttctcggacggtacttcgagtcgttgcgccacagcggtaatgatacgctggttagcctgatgaggaatcacccagtcaacctcttccttagtcagatggtttctggcgataatagcttcacaggaatccgacatattcgctacggcatacttgaacaccgtgcggccttcctgataaatataatgcagatgatgatccaatgaataataggaaggaggacatacggaacctcccgcttttatatgcagaaaaggcagccctttaccatccgttctcaacaccgaatccatgatgccgacctcttccgtagtcggttccagcataaaagcggccgcaccgtcgccaaagatagggcaagtggcacggtccgtataatcgattacggatgacatcttatcagcacctacaataataatctttttatatttccccgaacggataaaattcgctcccgtttccatcgcatacaggaaaccgctgcaaaccgcctgcatatcgaaagcgaaagcattcttcagccccagcctttcgcacaagatagatgccgttgaaggaaaacgatagtccgaagtggtagtggcgacaatgaccagatcgatatcatcgggacgactctttgtgcgttgcatcaactgcttggcggccttacgggccatatacgaagttccaagcccctcttcattcaagatatgtcgttcttttatgccgatacgccccatgatccattcgtcggtggtatccaccattttagaaatttcatcattagtcagcacataatcgggcacatatcccccgaccccagtaattaccgcatttattttatccatcaagtctattttcagaattacaaaaatgtgatatctcaaaaaaaatatcgggcgcaaatatacagaaaagagaatgatatacaagagaagagtactagaaataccagacactttgacctatgaaaagaacttttggctaaagaacgagaagttttgactaaatttcagattcagcggagagagcgggattcgaacccgcgatacacttttggcgtatacacgctttccaggcgtgcctcttcaaccactcgagcatctctcctttcaaaaaactcaataaacactaagaaaacgctcccgttttcgtttcacgacatcggaggcgtcgccctccataaaaacaaaaaagcagcccaaaagctgcttcccagcggagagacagggattcgaaccccgggtacctcgcggtacaacggttttcaagaccgccgcaatcgaccactctgccacctctccaaaacttccttatcagaagtgcttttcgttaaaagcggtgcaaaggtacgaagatattttaaacttgcaagagttttcactaaaaatttaatctaatcttttcctaaggatagcaattaataggtattttatgttgaaaagcataaaatagagcatatttatgctgattatatgaaaaatgattgtaactttgtgcgctctaaagaataggataactacaacctctaattttatcattttatggaattaaacaagatctttaaagacggtctttggagcagcgaaatcaacgtcagagatttcgtaagtcataacatcactccgtattacggagatgcttcattcctcgaaggacctacagaacgtaccaaagccgtatggaaccgctgcctcgaagcgttggcagaagaaagagaaaacaacggtgtccgctcattagataatgttaccgtatcaaccatcacttcccacaaggccggatatatcgacaaggaaaacgaactgatcgtcggcctgcagacagacgaacttctgaaacgtgccatcaagcctttcggaggtatcaacgtagtcagcaaagcctgtcacgaaaacggcgtggaagtggacgaccgcgtaaaagatattttcactcactaccgcaagacgcacaacgacggagtattcgacgtatatacggaagaaatccgttccttccgttcgctgggattccttaccggacttcccgacaactatgcacgcggacgcatcatcggtgactaccgccgtatggctctttacggcatcgaccgtctgatcgaagcaaagaaggaagatttgcacaacctcaccggtccgatgacagatgcccgtatccgtctgcgcgaagaagtggcagaacagatcaaggcactgaaagacatgaaagtgatgggcgaatactacggtctcgacctgagccgtcccgcttacacggcacaagaagccgtacagtgggtatatatggcttaccttgccgccgtcaaagaacaagacggtgccgccatgtcactgggtaacgtttcttctttcctcgatatctatctggaatatgaactgagcaaaggaaccatcaccgaatcgttcgcgcaagagctgatcgaccagtttgtcatcaaactgcgtatggtccgccacctgcgtatgcaatcatacaacgacatctttgcaggcgacccgacctgggtaaccgaatctctgggcggacgtctcaacgacggacgtaccaaagtgacaaagacctccttccgtttcctgcagacattgtacaacctcggcccttcaccggaaccgaacctgaccgtactctggagcccggaacttcccgaaggattcaaagaattctgtgcaaaggtttctatcgacacttcttctatccagtacgaaaacgacgacctgatgcgtgaagtacgtcagtccgacgactacggaatcgcctgctgcgtatcataccaggaaataggcaagcagattcagttcttcggtgcccgttgcaacctggccaaagccctgttgcttgccatcaacggcggacgttgcgagaataccggtacagtcatggtgaagaacatccccgtactgaccagtgacacgctgaagttcgaagaagtaatggacaactacaagaaagtactgatcgaaatcgcccgcgtatacaacgaagcgatgaacatcatccactatatgcacgacaagtattattacgagaaagcccagatggctcttgtagatacgaacccgcgcataaaccttgcttacggtgtagccggactttccatcgcactcgattcactgtctgccatcaaatatgcgaaagtaactgcccgccgcaacgatatcggtctgacagaaggcttcgacatcgaaggagaattcccttgcttcggtaacgacaacgacaaggtagaccaccttggcgtagacctggtatacttcttcagcgaagaattgaagaaattgcctgtttacaagaatgcccgtcctaccctctccttgctgactatcacttccaatgtgatgtacggcaaaaagaccggtgctactcccgacggacgtgccaaaggtgttgccttcgctccgggtgccaacccgatgcacggacgcgacaagaatggtgcgatcgcttctctgagctctgtagcgaaacttcgttaccgtgactcacaggacggtatcagcaacaccttctctatcgttccgaaatcactgggtgctacggacgaagaccgtatcgagaacctcgtaacgatgatggacggttacttcaccaaaggtgcccaccacctgaacgtaaacgtactgaaccgtgatatgctatacgatgccatggagcatccggagaactatccgcagctgaccatccgcgtttccggttatgccgtaaacttcgtgaagttgagccgcgaacaccaactggaagttatcagccgtagcttccacgaacgtatgtaatctattactctatatgatgataaacgtacattcatacgaaagtatgggaacattcgacgggccgggcttacggctcgtcgtttttcttcaaggatgcaacttccgctgcctctattgcgccaatccggatacgatagcaggaaagggaggcacgcctaccccaccggaagaaatcgtccgcatggcaatgagccagcgccccttcttcgggaaacgaggaggaatcactttctccggaggcgaaccgacgtttcaggcgaaagcactcgtcccgctggtccgcgaactgaaagaaaaaggcatccatgtctgtctggacagcaacggaggactttggaacgaagacgtagaagaattattcaagctgaccgatcttgtgttattggatataaaggaattcaatcccaaccgccatcagacgctcaccggaagaagcaacgagcaaaccatccgcacggccgcctggctggaagaacagggaaaacctttctggctgcgttatgtgctagtgcccggatacagcgattttgaagaagacatacgcgcactgggagaagcactcggaaaatacaagatgatccaacgggtggaaatactgccttaccatacactgggcgtacataagtacgaagcgatgggacaggaatacaagatgaaaggggtaaaagaaaatacccccgaacagcttgaaaaagctgcggaggtattcaaagagtatttcactacggtagtagttaattaatggagaattctccaatgacctcaaagcaagggcattctttaatccgttcccaaggatctacgatcccattatagttggtgtcgggacttaaatcccgatgccctactactttagcttccggataacgctgcaacaattcgtgtaccaagcgatgtagcgcctccttctgacggggtgtacgcgtatccgccgcttttccattctcatccagaccgccctcatagcatacacctaagctgatcgcattatagccacgtgcatgagctccgaccgtatcttcatcccgcatcggctcaatctcgcccgacttgcgtatataataatgatacccccagcacgaaaagccacgataacggtgagccgtatccacatcctttgccgtaaagtcgcaatcgacacgggtggcggaacaatggatcacaatcagactaatctttctcatgttccttttccctttccgtcgttttcactttgcacacctccttacaagtagtatgatagcgcacttctctcaccaccctgtcccgctttctctttccgaagaaaggaatcagatacatgatcacatctaaaatccggtttactatttctttcatcttatcaaaatattaagtggtagttattctaattcgttattaccttgacccgtctgccaattataccgtagggtccggagcctcttcatcgccggagccatcaccgccggaaccgggattcttgtcagggtcttctcccccgccatcgcccgcacccgcctgcgccaccgcacgggtcagcacttgctgataactcagaatcttcatcaactccgccagcgtctttccggggcggaaaataagatgcgcccccttaatcatcgaaccggaaaactccttgaccgatgccgcaccttcactgttcagtcctatctgcaaactgcccaaatcgcccagtctcgcaattcttcctgccttcaacgcacgcttcacttcgtaaagaatacccgaaatagccgcacgtacatccgtttccgtacaagtagaacgactggtgatcgcttcgcacaactcttcaaagtccaactctcccgacgcctgcgcctgtgcataatactttgccggttcgctcttttttgcaggattcttgcgcggcaccactgaataagatactgtcattgccataataaaataattttaaagtttataatacataggatgcatccctttcttgttaacagcacaaagataaggatagccggacaagccatattccccaacgaagtttcttgattcccaacgaataaaaacgaagtcaaacctttgaaaaacaaggaattttatgtaactttatagcataaaacaagaagaaaacatcatgaattacaaagaagattctttccttatccgcacctataccaaagcggaactagctcacctttacaatccccatgtctgcctcaaagttgctttacaaatacttcgtcgttggattatttacaacctccctctcctgcacgaactcgaacaggaaggataccgcgcacgcaaccgtctcctttcgccgaaacaagtggcaactatcatacactttttgggcgaaccgtagtaacttattgccattttatacaaagttcctttacacatttccgcaaagaagttcctttgcatcgacaaacaataatcaaaataaaaatgaaacatttcaccatatttcaaggtttctactacgcaatagcagagatgaccgaagaagaaatagtgtccactatcggcagttttacctaccgggaaaaagtcgaagaaatacgccgcatctttgcagagcaaggagaaaaggctgccaatgagaagaaaaaagaattgccggcaatcgccttctccgccagctaccgaggaaggcgtaccaaagtgaacctcgtcaaatatctgggacacatcgtgatagacatcgaccacctcagcaaagaagaattggcacgcatcctccctatcatcaagagatgcgattacacccgcatcgcctttatcagtcccaaagggatgggcgtgaaaatcatagtgcgcgcatgccatccggatgagacattgcccgaaacccttcaggaaatagaagacttccatcatgcagcttacaccagactcgtttctttttacaccgaactctgtcggatagaaatcgacacctccggtcaggatgtggcacgcacttgtctgttctcttacgatccggagatctatttcaatccgaacgctgacgcttttcttgtagatcaacctcaggcatcctacaagatttcaaatcgtaaaaatctctccggcagtaaacaacagactcctccggacggcaccccgacgaatgaagacacagcactcaacgcccattccgccaacgcttctttggtgttgactttaacttactatcacaacaagtccgaaaaatacatagcaggcaaccggaacaattatctgcaccatctctcatgtaccttcaatcgctacggcattccgcaggaggaaacatccgcctttatcaaaagccagtttacagactttccggcggacgagacagtctctttgatcaatagcgcctacgctcataccgacgaatttaatacctgtaaactgaatggcacgcagaaacgaatattacggatagaacaatatatcagcgagcactacgaaacacgctacaatgaagtgctgcatatcatggaatatcgcagaaggcgtcccgacaccgagaaaccggagcctttccgcatcttggatgagatgatggaaaacagtatctggatagaaatcaacgagctgggatatccctgcactgtcaaaacaatcgaaaatctgatttactccgatttcagccagtcgtatcatcccattcgcgagtattttgaattactgcccgaatgggacggaaccgactatatccgtatcctggcggatagtgtccagacgagtcatcaggagttttgggcggaatgcctggaacgttatctggtggcgatgtgcgcagcggctactcaggagaatattgtcaatcacacggtacttctgctatgcagcgagatacagaacataggaaagactacctttatcaataatctcctgcctcccgaactgcgtgcttatctctctaccggactaatcaattcgaacaataaagatgatttagccaaaataacgcaggccatgctgatcaatctcgacgagtttgaagggatgagcggtcgggaactgaatgcattcaaagatttggtaacgcgcaaagtgatcagtttccgtctgccatatgcacgccgttcgcaaaacttccctcatacggcctcttttgcaggaacctgcaattatcaggaagtgcttcacgacacgacaggcaaccggcgtttcctttgttttcatccttattccatccaatttattaccatcaattatgcgcagctctatgctcagatcaaatatctgctgaataagccggggtaccaatactggttcacgcaagcggacaatgaacggcttgaagagaataacgaggctttcatctttcattcaccggaagaagaaatggttcttacgcatatccgcaagccggaacgttttgagaaggtttattatctgactgtcagtgagattgcggaactaatacgtgagcgtaccggttatcagtattccatcggatcaaaaatacagttggggaaggtgatgactaagcaccattttgaatctaaaaaaggaaataacgggcgccgatatgccgtatttattatagatatcgagcaggtaaaatcaaacaggctgtatgaatagaagcgggaaagccttgtgaatatagcaaaatgcagagtcatcttgacagatactctgcatttattgtttttacaaaatcattgaaaattcgattttacagcctaacgcattcattatacgatagaaagtagatactttaggctctgtctgaccactttctactcttgaaatataagaacggtcagagccgatacgccgggctaattcagcctgagtgattttagccttttttcttgcgtcctcgataatctgtcctgtataaaaggcgtaggccttttcttctgcctctgcacgagaagctgttccttccttaccaaaacgctcatctattaatgcactgacattaaagaattcctcatttgtttttgcttccataatactcctttcttaatatctttgctttatcaatttctttctttggtgttttttcggttttcttttgaaaaccgttaaacagaatcacaatacgcccttcgtcgaaacaaaagaatattctatatatattgctttggtactcgatacgaagttcataaagtccttcttctatcaaccgcataaatttcaaaggtattctgtcttgtgtctgcaataacattagcacatacaatatcttatcttgggtgccagcatctaaattttcaaagaattctttgaagtatcctttatatgctattatttctcttttcataacgcaaatataagaaatgttgttcaactatacaacacatttcctcgttttatattatttttcatcatcttcacccacaaaagtgagaggagtgagagaggaattgaaactttttctattttatttctttatttctactttctatatttctctaaaaaaaatacgaatgttagaaatcctctctcactcctctcactttttaccttttctttctccaaaaagacggcgggaaatcggaaaaacacaaccgtcttttttcgatttctcaccgcattttcaaatcaacccaccaattgaagcagacttcaggaaatatttgttatctttgatgtgcaaaagatcaaaagaatcagatatgggcaacttgatgcgtaaacttcctattggaatacaaacctttgaagatatacgaaggaagaatatcttattgtaaagatcggagtggaatttagttcagaaagccggaacttaaaccgttggttaatagagactattgagtaatagaaacccaagtggcggcaatctgcaacaagtttccatccagatttccgccacttttttaattcaaccgttcagcgatggaaacagattatttaaaatctccctccgaataatctgaaaactccccggcacgttctttcttctcatacgagaccaacgtttcgatactaagcgctttcccgttcttagggcttatgacatctatcacacttgacaaggaccggaacgtctgttcgcaattcgcgtctccattatacgtcaacctcccccggtcaatagcacctagaatgacagaaatgtaccgtttcggatctccccgatattcgataacagtgggcgtcatttgttcttcttcccgaatcagttggacgacaattcttttttttggtcaatcagctccaacagtttttcactatgcacactgatttgtgcatctacttcacgaagttcattcttcaatgaacaaaacaattcatcactcaatgaattttccataaaaacgatttttattaattataaaaaagccattccggaaagcacagctattgcctgcttcccgaaatggtgactaataccttcaaaaacaatgactctatttttactttaatgtactcaatttatttcacttcttttctctcctgcattccaaaccaacaaagcaaacactactgaaagcaaggctgcaccaatccaaaaccaattgatatatgtaaaatcgtaaacttctactccattttgcaccgtcttctgaccttcgatcagaatgccactcatcacatcctgcaaaccggctcctatataactcgctataccgacaactcccaaagcggctcccgaagcattgcagggagcaatatcgaccgccatcagtcctcctaaaaaacaaatcagcactccaatgcccaaaccgaagagcaccatcgccaaagcatccacccaaaaatgtacccccggaaccaatagaaacaaacaaagagcagacacattcattaatccgaatatcaaagccggaacattacgactgccagcaaaaaacttatctgaaataatacctgagaaaaccgtacctacaattccgcatacagaactgatagatataataaaactagcatccaaagtagaataacctttttgcgcttccagatagaaaacaccccagctattgactgcataacggctgatatacataaaagcactggataatgcaagaatccaaatagcaggattcttcaaaactgctttctgagctttattgaattcctcggtttgtttaccggaaacggaatgagcatctgacgtcccccgccgatctagcaaaaagccctgactttgaggcgtatcacgcataaaagcaagcatcatcagaaaaccaagcaaaccaatcactcccgcaccgatcatcccataacgccatcccatccaactgaccagcaaagcgatggatataaaagtcagagcttcacccaaattgtggctggccgaccaaaagccataaaaagtacctcgctctttactactataccaacgagtcagcgacacaactcctgatgctgcccccatcgactgaaaccaaccattcaacccccaaaggagaacaaaagcaaagaaggaattcgtgaatcccagacataagttgatcagagcagaacacaataatccggtagacataaaacgctttacattgctacggtcagcaagaaagccattggtcagcttaccgacggcatatacgaaaaaaaggcaggaaccgataatccccagttgggtttcggtaaaaactccgtcttctacaatcggtttacggattacattcatactcaaacgacaaacataataaatgccatatccggtagtggcagacagaaaggtagcccaacgaatacgcttgaaacggacagagcgttccggatcagtctctcccccggacaccggaggagagattttataaaaatccaatagtttaaatcccataaagaagtctatattttaatgatacgcatcttggccgttttcactacgcttcttacgcgattgcaaatattccagcagataggcagtacggtctgtctgaatgatggccgctccgagtgtatcgatcagataaccatatccttcgtccggattctccaacgatttatcatcatcatgtccgccagccatcgtatcccacaacgtattataccagattttactttttcctttcaacttcgtttttacttgcttgggggcctggcaggtatccgatacaaatagaagttcaaaagctacgggatgcagctccgtcataaaatcatccagttgcttcattgctcccggcttatccaaatgaatgataggcatataaatgatacggtccagatatttacctaagtctttctttacgtctgccacaggcttggaacctttcatgataatctgatccactgttcccgtcttttcgaggatgggaaaaatctcgtcaaatatcggatatgctttatccagattgaccatcacacgacctttggcaacccataaagcctcttccaaagtaggtacacgatgcttggttttgagtgccgctccatttttcagatagagtgtccggatagaatccaatgtccattcggctacctttccttttccggtagtcgttcggtccagcgttttgtcatgcatcaggatcaattgaccgtctttggttttctgaacatccagctccactacgtcagctcccagacgaatggaactttcaatagcggcaagtgaattttcgggtgcgtaacgccagtctgcccgatgagctacaaccgtgatttctttattgtcagggttcgttatcttcgcataaatggctttcaccggttcgtctgccgacaggcagaaaggaaatgcgaataagattcctatcattatatatttcttcatatctatatgtactattatctgtatcctttagactttaaatatttggcagctacttcagcatagtctgtttgcacaatgttgatgcgtttgttaatcattcccaccaaaccggagtagttttccgacaacatattggtatcattcgctccgacaatgttggagaaaagaagccagcctttatctttaatctcattaaccatcgttccacccatagcatctgacgtagacagctgcatcatttgtacattatcagtgtaggatgaggagaagtatgtgatgtcatcggtagctttcgccatcgggtgcaacagcaaactactgttggctgccttcaaatcaaatgcataattgcgattgttggatacatacagcaaagtggaaccttccatatccaattttttaagcaatgcgacgatcgtatttaccgcaacattcttgttgacaatatccagattataataaacttttccttttcctttcttcatcgcttcctccaaagtcgggattcgttcgccagttatattgccggatgcatctttcagataaaattgttgtaattgctgataagtaaagtctcccaccgcaccgctaccgtttgttgtccggtcgatggtgttgtcgtgcatcaataccaacacaccgtcagaggtcggccgtgcatccagctcgatcatctcaactcctgctttgaccgagtgttctatcgcaggtaacgagttttcgggaatcccctctttcatccctttttgggtatttccacgatgcgcgcagagccacactttataagaggtgctttcaaacagactctttaaatctgctttcaaattccccgtcacaggcaactgtcctccttcttctccaccgggattctctccattccctcccgattgggctccggagtgacgtctgtccttccctttcatcggccaggcagaggttgcggccccggtaattccctcatcttccaaagctaccaacacgctctttgtagggtccaccgtattggtgactccgatataaatcgctccatccggtccgatggtaggcgaactccagattttaccgattcccgcttcccaatctccttttaaaggagagtcactttcactaatcaacgcagcaaggtcttttttcagaatcaattgttcatccgattcttccggtttaatgatataataattgccggactgggtgccgaaatgtatgtttcctgcttgatcaattgccgcacaaccgcttacatcttccgcaatgccgtaatgccattggatagctcctcccggagacaaagagatgattcctccggttgcttcccccggagcacgtttcactgtaacgataatgcttccgtcgagtcctatcacaacaccgccttgatccagcgtgccgacattgcccaaaggagtacgccacttctccactccatcacttcctatagcaaatgcgctacttcccattcctgcaaacgtagctgttccgtaaatagtaccaacctcatctactgccggagaaccgttcatattttctgacggcttatcatcgccggagctaaatacctgccaagcccacattacatttccaccggcattcaacgcagaagcagaagccccgaacaatccattctttccgccaccccaaactaaagtgttgtttgccaatactattcctgcagatactcctccggaaggacctccggaattatccgcattcgctacgtatcctacccgatagccggtcaccttatctactgcaagtactgatcctgtagaaccgccattacccatatatacatgattctccccaatggcacaggtcaggtaattgatacggggtgtggaagcttttcctttattccagaagccattttcagcgtcacctgccaccagccatttcttactcccgtccggatttattgcatacacacgtcctactttgccactggtgtctccggttcctacgtagattgttccgtctatttcaatgcttggagtagtatgcgtatttccggatggtgcatcgccgtcagcagatgtccaaaggtcaaattcccaaagctggtctcctgtcgctgccgaaaatttacgtaaataatgatcattggaagtcatatacaccccattatcatcactgacagccggagctgtagaacgtacttctcctaacacatgaccgcctacccatttcagttttacatttcctacttcgggcaaaggctccgaatcaatggtcaacaatttatgagccatcgcataagtgccttttgcgtccttcacatgaagagtcaccgtataggcaccgttcgtttgataggtaactacgggattggggtccgttgaagtctttccgtctcccaaatcccactcataagtgtagtttccttctccgcctacggtttcattagtaatgcggacttcatctccgacataatacagcgacttgtcaaaagagaatctggctgttaacgcattttctttccagtcatccgaacaggctgaaaacagcagcaagcagatgcaaaacgttgcaaatatttttatattcttcataatctgttctttcttaatttattaataaccatcgttttgaggataattttcggctcctgccaaatcgcgttccgactggggaaccggatagtacattaaatagtttcttccgttcagcgaagtaaataaatccaaccgattggtcctcttcaagtcgtaccagcgctgtccttctgcatacagttcacgatggcgttcgtccagtatctgattctgaaactcggtgtcgctcatgcttgaaggtaatgagactgtagcataacgcttattcataaactctttcaaggtcgacaggccgttcgttgctcccagcgcttccgctttaatcagatacatttcggctacacgagccactactataggagtttgagaaggttgttcgttggtcacaaactgcccggtgcttccattcggaaatttgatgatccggctattgtctgccccaaaaactgcttgggcacggatatcctgcttcttgactgaagtatcggcataaagatgactatagcaatcggcagagggagaataatcccatgtcgggtcaatatcattaacagtctgatagaaaagtaacaatcccgtgctgcgtttattggccaaagcaaaaatcagttctttgctattactattggagatgaaggcattagcatattcaaccgatgtggtactcaatgcgaaatcggacttagtaatcactctgtctgcataaatagccgcattcgtataatctttcaaggccagacaaacttttgcattcagtgcatcacatacacttaaagatacgtaaaagcgatcggtaaattccggaagtaagctctctgccttgcccaaatcttctttaataaaattccacacatcagcttcgggtgagataggcactacatcgtaagtacgcttacgcaaaataggcgctcctccccaacgggtgactaaatgataataaatcaatgcccggaaataatagccggttcctccggtctgtttcaccacctgactgtctttattggaggatgcttcgtaggtctccaccaagaaatttacttgctttaaggctgtgaaacatttctgccactgccccaatacatctttggaactcggagccatcgacatcggatcattcatggaaaatcccgggcccgccttgaaattctctcctttcacatcaccgtccatatagaacttgaaaaccagttcttccatttcagcatataccccgttaagcaactttgtcaagtcggactcgctcaatgcgtcttgaggtatcttgtccttcggtcgcatttcatccagcatatttgagcatcctgtcatccataaaagacaaatgccgcatagtaaatagttgatcatataaaatcgtttcatactcgtctgtttttaaaagtttagattcaaaccaaagataaatgttctcaatacgggttgcaggccgaaatcaactccgtaattggagtctccgggactgcccgagaaagaagtttcgggatcgtaacccgaatattttgtaaaagtcagcaagttgtctgccgaaacgtagaatctcagagagttcacatgaattttcttcgtgatggattccggcaaggtatatcctaatgtgactgttttcagtttgaagtaggaagcatcttccagatagcgggtggatgtctgaacattgtagtcataatcatatccggtatgcacaccgattcttacaggacggggaatcgagttgctggtgccttcaccgcgccagtatccgttggctacctccttactgatattgaagaactgttctacggattctccatggtcgcccacttttacgttagacagtgccagacctaaatggtcggtaccttcggaaccattgacaccccgccatgccgccatcacttttccacctacggaaaattgcccgaataatgacagatcaaaacctttgtatgagaaattagaagtaataccaccgtaaaagtcgggaatagcttttcctacattcacacggtcggcgtcggtgatgtcgccatcttcattgtaatcaaaatatctcacatcaccggcacgcactcccttggcataaagtttggcgggaacttcatcgtcacgctgataaatgccttccatcttcaacatataaaatgtactgatgggttctccgttgatcaaagcatgcatggaaccacccaaaaggttactcccgctactgggtacaacgtacatttcacttccttcaattaaagagagcagtttattctttacgaaagaaatattacctcccaagtcccatttgaattttccggtgagaattttgccgtttaatgccaattcaagtcctttattctccaacgaaccgatgttagactgtagagtggtatatccggtacttgcatttacaggtttcttaaacagcagatcggtcgttttctgatagaacatatcaacgttcaaggttaaacgagactgaaacatttcgatatcaaaacctatattgaactgacttgccttctcccaagtcagcgcacgtgcgtcctgtgaaatctggaatccggcagagccattgtaggatgcgcctcccgcactaatgagcgacaacggagcataattgctgacacctgccatgctgcctgtcataccccagcttaatctcagtttggcatcattgacatatttgtttttgggaaagaagccttcattggaagctctccatgcaaaagaagccgagggaaagtaaccatacctcttattcttcgcaaagcgggaagaaccatcgctgcgtaacgaggcattcaggatatatttattatcccagttcagggcgattcgaccaaagtaagactccaaagcgtaggaagtataactgatatctccggcatagatgttcggtccggcattaatgagatcgaaactggacgaaggataggcaccattggcgtaattatcactctttgctccaaactgttcgtaagtgtatttctcgaaagagtgtcctaacataactgagtaaataagtttattccattcgttattgtaagaaaaaacattatcaatcacataacggaaactctggtctttctgttgtgccaaagctccccaaccactactgtttttacgggcatcgtgcttatccgataacttctttgaaacattatccaaaatgccgtacgcactcactgtcggtgtatatttaaaacctttgaagggggtgacgtctatactgaatactcccgacaactgatatttctttgctacccagtcttcttcatttattaacatgaggggattatggcgcagaatatccgttccattcactttataggatgtcccgtcttctttgtaaggagaataccaaggttgttcctcacgggctgtacgcaatactttcaaactggtactcgtttcttccaataagtccgaacgacttgccgaacctgccagattcatatttagtttgaagatgctgtttattttatgtgagaacttagcacgcatattgtattggtcatacttactcttattcaaatagccttcctgagtattggctcctaaggaagcaaaaaaagtagtcttttcatttccgccggaaatgctgatagaaccggcacccgtctttgagttctttcttgaaatctctttcacccagtcggtttcctgaatctgagaaggaatatacagttgcaggttggttcccatctgcacattgtagttatcaatagcagcctgcatagtattcatgtattccgttgaattagccatctctatatcactggcaagggaggcaaagccgtaacggccggatacttcgatctttgttttcccctgctgccccgatttggtagtgatcagcaccaccccggcattggcacgcgaaccatagattgccgctgccgacgcatctttcaacacttccatactctcaatatcattgggattcaaattcggatatttttcgctggggattccatccactacatacagcggtgaacttcctccgctaacggaaccgataccacgaacagttatattgggagtttcacccggtgttccggaggcagaagatatattcacacctgccacacgaccttgcaacatcttaatcggattgtaatcatttccctgatctatattctccatcttcactttactgatagaggtagtgaccagcttctgtgactgaactccataacctactactacgacttcatcgatcatcttactatcttcctcaagtactacctttaccaatgtctgatcggtagtagcaagattgactgtcttgtaaccgatataagagatggtcaagactgctttctccggtacgtcgggcaatgcgaacttaccatcaaaatccgttattgtcccgtgagactcacctttaatcacgatacttgcaccgataatgggttctccgttggcatcgacaactgttccggttacttttttcgtcagttgtttactttgtgttttacgaatcaacacaatgacgttttcctgttcttttttgtaagtcagttccattccttccaaaagacgtgtcatggtctggtcgatcgttacatcccgaacgttcaatgaaactttccaactcaattccggcagactctcactgtagaaaaacttgtaattactaacttgctcaatcttttttaatgaggctcttaacgagatgcctttcaaatcaaccgttatttgagaataagcggtcaaagaaatgctcatgaacagtagcagacaaatggcccgtaatgttctccagttcttacttctccctgctgtagactgagggagtttcacaaagggtgttctgttttccatatatcaaaacttttaagttgtttgacaggtataccgactgctctcccctttcgtccaatcggctatctatctttaactcttgttaactaacggttcttcataaattaaaaagccattccgggggaaaactcaggaatggctatatctaatttcatgataaagatgcttatctacttctctttcaagacaatgaccgagccatccatttcataataaaaaggcgaagtaagcatgagaatattcaaggcgttctgtatgccgccactaggaatcgttcccgtaaagtattctttaggaagtttattcgaatcgaaacgtatctccacatcataaatccgtgaaagagttttcatgatgttttccaacgattctttctcgaaatagatatttcctttcgtccattcaatataatcattgggatgcacttgggtagcaacaagttgatgagtggttttattgtattctattttatcaccgggcttcatcatacgcgaagtttcctgagtgtaaattcctactttcccttccaacaaaacaaccgtaatgtcttttgcatcttcataagcagatacattgaaggaagtccccaatacctttacttccaaatcacctacctgcactataaacgcatgtttctcatcaggagcgactttaaagtaggcctcaccattcagttgcactctgcggactttctctccaaaattattcagataactcaattgagaagctgagttaagcactacattcgttccatccggcaattcaactgtagctttatcacctttatctgctttgacaataaaaggcgcactggtcatttgcgacgaatcgatcaaataataagtgaaaaaagcaatacagacaggtaacaaaatagcagccacccacctccaaggaatcatagggagagttctcacgcccttcgttctcggtgacgtatgtttcagtgttccttcttttatccgtgcaaagagtttatcacgcagtatcggatcaatagcggcatccgacttggtaaactcctgttcccaccagttttgcaactgacggtcgttctttatccaatcggacaactcctttatttcagtgtccgctatatttccttcgaaatatttttcaatcagctctttataatgtatcttatccatcttcctacttatttacaggtatacattttcatcctatctgccatccaaaagcaaagattacaattacatttcattaacaaaaaaaggcaaacagaagcgcaacgattttatcataatgcttcattaactgctcacgcataaacttcacggccaaagatagttgcgtggcaactgtactttcggaaatgcccatcatctccgctatttctttatttgtataattttgccttttgctcagaataaagattttcttccgttgcgccggcaattcttcagccaaagaatcgatatattcattcaagaatcgcaagtcaatactttcttctgtctgggagtcacggtctactccagtatttttcaaatattcattgtaaacatactctacagtctgacgctgatacatattcattaataaattcttggcgatggtacaaagaaaagaaataaatgaagactccggctctactcgctcacgtacttcccaaacacgtataaaggcagactgaactacttcttcagccatatattgattgccggaagaaattcgcataatgaagttgtataacttaccgctatacatattatataatctttcaaatgcttgaaaagagccgttctttaattcggttaataaacgtttttcatttatagaatccaccatagcttagaattttgcaacaaaggtatgttaccatcggtcagaaacaggtgacaatgatattaatattttctcagatttccgatttttcagcagagtttctgcacataaaactttaaaagcgatattttaaccgtcattggtaaaatatcgcttttaaaatatatagctcaactatattgactaataagtaagtcggatacccgcctgaatattgaagttgaacggattctccttacggatggtctgtacatcagaaccatcatcaaagaaataagcaacaccgggttctacgtatatacctacccgtttggtggcattaaactgtgcgccgactgcaccggagacggagaattgcaaaggtttcacagtttccttttccgtgcccagcttaccataaacacatttctcaatcatacctccaccggatacataaagagtaaacagtttcttatcaaggaagttccagttcgcttttaacgggatacccagataatgcagtttctgttcggtcttctggtcgctgtccgcaaactttgcatccgaagaaagcaaggtgtaagtcaatcctgtttcgacagagaaccctttcgccagactcttgcggacagataatccgaaggagataggttgatggtgttccatatcgaccacctgattggcctgacgcaaatatggtactccatcttcaaagaccaattgctgatcattgggtatgctcagcagaccgtttgataccgataccatgctcacacgggacatataagaaggaatgcccgatcccaactctgtagaagcaccaccggagttacctaccgaaagtcccatcgaccacgtgcctttctgcgaagatgctttttctgccggaatatgcagtttgtctctgctggaaggacggcgtggcttatttctcggttgttccgtatctgcgggcttatgccggatggctttcgtttcttccaccggttccacttcttctttttctttccggtcgccggtctgagcgttcagctccgaaggttgctcttctttcttcaccggttcgtcgatatttgccgttggttggggaatgttccgttccgctttcgcgatgcggttcttcactaccggacgcactaccggttctatcgttgttcctgtcatatccggttgctgcgcatccggcaaaacatccggaacagaggctaacgccggagtcttggcatgacgaatttcatcagcagcaggagtcccgaggaaatacaggctgaccgatgaccccaaagccaataaaatgacagccgcagcggctaccgtccatttacgataaggatatatcttcctctccacaggaggcataagttctttttccagttgttcccaaccggaagcaggaagcggctccgagtaatccccgagcttctccttcaacttattcatccataattctttctcttccatatctctacctatccgttattcattatccattcttttactctcttagccaacacgctcttcgcccgaaataattgcgaagccgatgacttctcattaatacctaacaactgtgctatttccttatgcgatttttcctcgaaggtgtaaaggttgaacacggtacggtatcctgccggcaactcttcgataaatcgcatcaataccgcttgcggaatcatctctacagccgaagcgtcgggttcctcgtaatcttcgggtacttcttccaaaggcgtagactgactgattacatcactcttgcgaagatactgtaaagcggtattgaccatcactcgttccatccaggcccgcagtgagccttcaccccgccaggtgaacttgtcgaaagaactgaatatctttataaaaccatcgtgaagcagatcctgagctgtatcacggtcgccggtatagcgcagacagacgcctagcaaacgccctccataatgctcatacaattctttgcgggctcgattatttcccagcctgcattgttccgacaactcaaattcttccatttgcttatacacgtgtttaccttataaatgcagcaaagatagaaatactgcacagagagaacaactcttttgcaacttttgtttctttaacagatccaaatgcaatattttctccccccttgcattttcagagtacaaagcaagtaaatagtactcattaaaaaacatttttatagtatatgaagaaatttaaattcattgcatttattattgctgttatgaccacaatgccgatacttcagtcgtgtctggatgatgatgactcctcatccgattcactggtcatcagcaccatcaatctgatcagcccggatagcaaggatttctatttcactctggatgatggaaaaacaatgttcccgagcaatggaaacggatggatcagtgacaagaataaagacgggcaacgcgcctttgtgatattcaaagagctggaagaaccggtgaagggatatgactataatattcaggtaagagaaataaaagagatcctgaccaaagaaatcgtgactatgggggaaggagaaaatacggaagagaagatcggagacgataaaatcaattctacttatatgtggattacccaagacaagaaatatctgacaatcgaattccaatattacggcacgcatagcgaggacaagaaacatttcctgaatctggtcatcaacaacaaggaagctgaacccgctgccgatgatgccaacgatgagtatatcgatcttgaattccggcataacgacgaaggcgacaccgccgaccgtctgggcgaagggtatatatctttcaaactggataagattcaagatcagatgaaaggcaagaaaggactcagaatacgtgtcaagaccttatataacggggaaaaattctatgaagtgaaattcccctcatctaattaaatctagtaattatagaaacactctttttattataatatataattacgcaaaagagggcgacagttgtgaaactctcgcccttaattttatcataaagtgatccgtttatttcttcttattatttcttttcattcttgtcaccgaaataattccagacgagcgcactgacagccgctcctacaaacggcgctacaataaacagccacaactgcgacaacgcttctccaccctggaacaatgccggaccgatgctacgtgccggattgacggaagtacctgtaatagggatacatacgatatgcaccaataccagagaaagaccgatggcaaggcctgcgaaagctcccgcccctttcttcggatcggtagaccccagcaccaccaatacaaaaatgaaagtaaagaccacttctgcgatgaatgcctgtagcatctcgccgtcaccaaagccgttggaaccggtagccgtcggtccgtcatgcccgccggtggtcaccagggcataaagaatagccgaaccgataatcgctcctataacctggaaaagcatatacatacccgcatcttttccattcatacgacccgagaggaatactcctaacgtaatagcaggattgatgtgacatcccgaaatacctccgatagcatacgccatcgccactactgaaagtccaaatgccaaagcaacgccgaccgttcccacgccggctcctacagtaccagccatactgccggcaaaaacagcacttccacatcccatcaggacgagcaccatcgtcccaatcatttctgcaatgtattttttcatattactaaataaaaaatggttgattctccaaatataaggaattaatacctagattcaaaatgtatgtgcctaattattactatctttgcagcatttttgaataaaaccaccaaaccataaaatgaaaaaaggacttttttatgctatactggcctctgtattatgggctatcgtcaatccgtttatcaagcaggggctgagttacgacttttcgccgatgaactttgcaggaatccgctttaccactgtaggtatcattctttttgcttatacctggcataagggaatgtggaaagaaatacgccaacacagcaaactgtttctgaatctgatcctgatcaatatgtttatggggtacacggctttctatttcggagtcgatttcgtcagcggggctatctcttctatcattatgggaatgacacctctgatcaatgtactgctagcccatctgctggccagcaatgaccggctgaatgtgcacaagattatcagccttattgtcagcctcatcggtttgctgcttatcgtaggcatgggcagcaatggcgctccgctggactggaaagggatcacgggaattgtacttctgctgctcagtatcatctttcagggatattccgcgatttcggtatcggaagataaaggcaagataaaccctattttcctgaatgccgtgcagatgttcttcggcggactgctcatctatatgataggattaggtacggaagggtatcattcatttatcggaaagcctgccggattctatatcagtctttctattctggtatttatctcggtctttgctttcagtttctggtttatcgccttacagagtaaaggagccaaagtgagtgatatcaatatgtgcagactgatcaacccgatattgggcgccatacttagctggatcatgctcccgggagagtatccgacattcagtaccgttgcaggaatgattatcatagtcagctccctcattatctattttaagggagctgaaatagggcgatggttgaaacgccatacagccggaagcagtacgcaggaataaacaatattacagcaagtactgaatggattgcagggattgcatttctttgggtactgctgccagtatctcttctttgagtacattgagcaggctatgacggataaaatccctattggtcgcaagcactatctgccgtgtaggacggggaatggcaaacggacgtaccagtttcttttgttcttcgttcagttgcgaaacagccagttcgggaatgaaggtgattccttttccgctttctaccatacgcataaaggtttccatacttcccagatggtaggccatctgattgactttgaccgtttccatctggcagaaacgtacaagctggtcacggaagcaatgcccttcgtccaataaccagagacgttcgcccgttatatcggaagtgcgtatcacgtcgtgcttgaacagaggttctttgcaggatacatatccgaagaatgtttcatagaaaagtgtttcttctttcaggaaagtgtcttccaatttgctggctataattgcggcatcaatatctccggcatgcaatgcctgctggatattctgtgttttcatttctgtgacacgtatatccagttccggatacttttccatcagttgggggaagaagcggggaagtaaataaggtgctatggtaggcaatacccccaaatggaacacgcctgccagtgactgtttctcttcactgattatttctttcacctgcgctgtctgtgccagaatgacacgtgcctgatcaatgatcttttctccaatcgctgtgggacagaccggctgcaccgtacggtcaaacaacttcactcccagctcatcttccagtttctggatcatagcactcagcgtgggctgcgtcacgcggcaatattccgccgctctggcaaaatgacggaactgatcaaccgccaatatatattctaattgttgtattgtcatctatcaaatatgattaagttatagatttcttctatgcaaagatagaaattatcagtttgacaacaagcattttccgccttatctttgcagtacagaaaaaagaaaacgaatataaatcattaaaaacaaatagaatatgaaaactttagaatttatcaaattgaacgaatcgggagcaaacaacgtagtagcatctttgcaacaattactggcagacttccaagtatattacaccaacctccgcggtttccactggaatatcaaagggcatgacttcttcgtacttcacagccaattcgaaaagatgtatgatgacactgccgaaaaagtggacgaaatcgcagaacgtatcctgatgctgggcggtactcctgccaacaaattcagtgattatctgaaagtagccaatattaacgaagtggataaggtaagcaacggagaacaggcactggataacatactacagtctatcagttatctgatcggtgaagaacgcaagattctgtctatcgcttcacaagccggagatgaagtaaccgtttcgatgatgagcgattatctgaaagaacaggaaaagctggtttggatgttgacggcttataacagcaagtaaatacaaggtttaggttttaagtgaaaaacaggctgactcgtgattattcagaatcagcctgttccatgtttataaactcagattagaaataagtctcttcgtcactcacagactctctacagaaatatcttttgttagtcttatgtcatccgaagaggcaccaatcattatccggaaatctcctgtttccacaacacgtttcatattccggtcgataatggacagatctttttcggtcaaagtgaaaaagatttccttctcctctcctcttttcaggaagaagcgttcaaaacactttaattgtctgagaggctgaactactgaagcatattcatccctcagataaagttgtgccacttcttcaccgtcatagcttcctgtatttttcactttgaatgaaacttcaaaatagcagggagatttacgcattacctgtaaatccgaatattcgaaagtggtataactcaacccatagccaaaagtgtataatggagaagcagcctgttcgacataatcatgattgcagggagcctttttattataatagacaggtatctgtccaacagaacgggggacggaaaccggcaatcgtccggcaggattataatctccaaacaaaacatcagctattgcataccctccttcctggcccggataagaagcggtcagcaatgcgtcggcatactcagatgcccagactttatccagcggacgaccttcaatatagacaacgatcagtggcttcccggtagccttcaatgcattcaataaatcttgttgttttcccagtaaagtcaaagtagccctgtcaaacccctcgccacattccatgtcgctgatactcttttcgtcagcaattgctgcacccgtctcctgatagctcgtcttgaaatcgcgtgcgctggaacctcctaccaccgctattataacttccgaacggctagctgcctccaccacttccgctatttcgttcactgtcgtatcacgaatagcgcatccacgcacgtactccaccttagaaggagacagtttggagatcactccgtctaacacggtttttatgttttcatcttcttgcggagctgtatagtcccccagcatattataacgattatccgcattaggtccgacaactgccacttttttaatctttttattcaaaggaagaatcgaattcttgttcttcagcaatacgatagatgattgcgccactttatgtgccagtctgatatgttcctcactacgtaccaccttcgttgcagacttcggattcacataaggatgctcaaacaaacccatttcaaacttcatccgtaatacccggcatacggcagtatcaatcactgcttcactgatttttccggattgaacggcatgagtaagattcataaatgcattgccccccaaatcaatatccactccggcagaaacgacctgcatagctgcctcttctatagtaggagcaacaaagtgactttcatggactccttcaatactatataagtctgaaacaacaaagccacggaatctccactcgttacgcagtaattgtgtcagcagataataattagccgtacaggggataccatctattgaattgtaggaggtcattacagagagtgctcccgcatcaatcgcttcctgaaaaggaggaagaaagttttcgtgcagatctctagtccctaccgatgcataattaccgttttgtccaccttccggtaccgcataagctaaaaaatgcttcagggtagcgatagtagcatattcacgggataggtctccgctacctagccctatgaccatcgccgctcccagtcgtccactcaatacaggatcttcaccaaaggtttcttcgacacgtgaccagcgaggatcacgagataaatccagtacaggaccataactgatatgtgcaccctgtgaacgaatctctttagcaatcacatttcctacttcttcaatcagtaccggtgaccaagttgccgccatccctatgccggttggaaaaacggtcgttccaatcgccatatgtccgtgaggcgcttcttcagccaaaaataagggaatacccaaacgggtattttcaatcacatatttctgcaatgcgttgccggctttggcagccagttcgggattaagtccattttccaatgtcttcttagtccaagggtccgcacgataagttgcccacagcatacctgcgttcttttctttcattagtcttttaaacttttcagaaggatgtacttcatcgtcctttatttcgtacatttcccaaccaagaggacataatagttgcccgaccttttcttccaacgtcatacgtgaaagcaagtctttcacccgttcgtcaacagacaagaccggatttttataaggtaacagagaagattgggcaaaagccacgacattcatcgccaaccctacaatcaaaatatataatcgctttgtcatcatacaatatgatataatataaaaattactttccgttggtttcgcagaagtttcatgcggtgaaactttagttccaagctgacgaaacttttgtttcaagctgatgaaactttagtttcaaacaggagaaactttagtttcaagcctcagaaactaaatgttctgccaattgaaacaaaccaaagatactatcaattcaaagaatccatcaagagatcactgtacttccctaataatggttgacttgtttatctctaatagctgctatgtgttgactagaaatattactaaccctggctcagatttgctctcgggacttgataaatactcacgaatataagacattcgttcatcatcactgtaatagttgtactgctttttcgaatatttcatctttattttcgatttttgaagtgtcaacttattcagtacactacatactgatgctgtatataatggatggaaccagtttatacccctatgccataacttcagggtggaagatacagatatgtaaataatattatcaaaaaaggaagaaaattgggatctgcacaaaaaaatgaagagaaaagtctctaaaaattaatactcctctctccatttatagaaaataaggacatttactgaatatccctaagtagaactgtattatactgctggccattatgaagactgtatcctctttgattatccttatttttttgagtctatatttgccaccaataagtgacaacagtcattttcttagtggcatatatattatcatttgtttagcaagacaaatcccttactttctaacacatcatataccacttgtttgtatggctctaaataaacgtttcctggtatatgctgccgaataaatattcgtggaaatacatttttgattaaccattttaataaatagtgatttgaccaaaatccataatatatatcttccacaaatgctccagacagtactttgggatagtaacttgtctggcctaaatctacataatctttatgtctaatttccgcttcctctaccattcttcctaatgcagttatgtataataccctagtatcatctgttttatatttaatccccatgtaaagaggaataaggctttttgcatcttcaagaattaaggtcatcaatcttacttcccctaacttgtctttagctatcaataaaaaagatttggaagagaacagcatatttaggttttcaaagaaggttacatttaaaaattcaaatttgttttctgctttgtttaacacattgttatataactccgtaaacaataatgtttgatttgcaaaatcggtcgatatctcccacatgaaattctcattaaatgctttttgcgaatcctgaaatcttttcctgtatttgctttttaacatctctgggtatttatggctacttaatactggaataacatttgttggaaacgatgaaaaaaagtaaaaatcatgacctaatattttttttattgaatcaatattacgccctctgatatctttaatgaagacaaacttcgattttgtctgtctacacttatttttcaattgcttccttactaaatcaaagacaatctgccttttttctgcagacaaagttgttttatactctataaaatgttcacagctagaagcatatgttcctgtaacaaaggctctaatcttgaaaaaatcaatatagacttttcttatcttttttaccacagcctttaccattggagatgtggtaagatttaagatgtctatttcataactaaagcatggaactattgcaacgacagtcccatgttcaaatatttgtaaataataaattgtaatttgctgaaaatcggatttttcaatagatatgaaaaaccgttgacttttaattatacttttaccgaatatatcttcccaatcagataaagtaatatcattaacagatgtactccattttatagagtagttatttgacaaatcttgaaatgtcatacttttcaaacagtttaatgattaattcaaccaacatatccatatctttctgtgtatgacttgccattacacttattctaaacctcgtcaaattcgctggtacagccggtggaaaaattggatttataatgaatccactatcaaaagcatcctttgccaattgagttagtatagcttggtctcctacgaccaaaggaataatgggagtctcagtattcattatattaaacccttcgcttttcaatttattttgtagatattcagcattttgttttaagtgctctacaatttctgtactttgcatcacttttattacctcaatagctgctgcacatacacttggcggcaatgaagttgagaacatattacttcttgcatatatccgtagataatcaataacatcttgtgaagccgttatatacccccccaccgttccgattgccttacttaatgttccggttaaaattatattttttctatcagtaatcccatagtgtgacaatgtaccagcacctttgtcccctattacccctgttgcatgcgcttcatcgacaagcaagatagcatcatatttccttgttatctccagaatttgtggaagttttgctatatcgccatccatactaaataccccatctgtaacaaccagtataccattgggatattgaggactattatcttttaacagtctttccaaatcattgatatcaccatgtttgtatcttatcatttttgcaccggacataacagtgccatcaagcaagctggcgtgatcaagtttatcatgtatgataagattatttggacgtattagtcctgaaataactcctaagttagctgtatatccagaagaaaaaaggatagtatcatccattcctgatattttagcaataagtttttccaattcttcttgatatatggatgttccagttaataaaggaacaccacctgatcctatgccaaactctttagttacttcgatggccttctgaattgcttcaggaaagatagttgcacccaagtaactgtttgatccgaacataatagcttgcactttttgttgagtatggcgattataaactgttacacgtctatcacaagcagtcaattgtggatgttttctataaacattcaactcgctttgctcatgcaatgccatttcttccttgaaatcatggactttacccatgatagatccatctttgctggttctatttcccgttaaatttacaatgtagctcatatctcagtgtattgtttcgtgcgttatacagtatatacggtacaaatatataacttttttctataaatgttgttatcaaggttgtttatattaaaaagtatatattttcttagttgttttctattaattatcagtatatttgcaaacagaacatactgataattaaaaaatatgcgagacggaaaaccaacaaaaaataggctactaatcgaagctttcaaattattcgcccataagccatatgatagagtaacatttgccgatttagaggaagtaacaggattaagtcgtggtgcaatattatatcatattaaaacaaaagaaaatttatttttaaatgttgttaataagtttatctttgatcgcaacagcgtttccaatctctcagagaaatttcactcaaacttaagcctttttatcactcaatttattgaaacttgccaaaaagaaaaggatgagatgctagagattggaatatcaaatgtcaataatgcaatgttaaacattgaaatatccgctttctatatattgcccaaaatgagagaaatcgccaatgaatggctgtgcaaggaaaagaacacttgggaaatcgttttaaaaaatgctatttctaaaaaagaaatcaaagatgatatcaacatagagctatttgttgatttatttcagaatatatatttgggaacatcttttgcaggagtcgttcatgaagacggatacaaaattgatcagttgaagagggaatttatgcagatttatcaattaataaaaaaataacgcaactatatactttattgtaccaacggttgtgtataactctttaatgtgccaatcgttattacatctattattctcattacaaataatataatcacatagtatttattggctttacaccaatacaatgtctcttgatttagctgagaaaacacaaagtacgccacaatgactgccagtttggcagatattgtggcgttaaagattatttgtattaattggtactgtttttgaaagttattatcagtgtcatcggcattccgttttgcttaaaattcatttttttggatataacggcagtttacacctatctttctgaaatcaagatggcggagttccttccgttgaaaagggaaattcacatgtttaactaaggaaaatattattatgggtattaaaacaggcccaaaaagaattgctatttccacaggaaaacctgaccgtcgtcaaagagacaacaagcaaactccaggaaatacaccatctttgaaaccccatattcataagaagggggattaaactccaaataaaaacggatgcctttggctgacatccgtggagtaaaatgttaaagttcatccttatcgtgtagcaacacgattttgaggtctatcaaagcctttgtcattttggcactatgacgatggcttttttcataatggtgcaaatataactcatcaagatgaaataggttttgttactatgaaaaaaataagatttattattattacaattatactatcctacaacatttggtttcaaccaattttcgagtaaacttaatcattttcttcatttgttgtttctttttgtttctcttctgattgactatctgccattttagcaatttctatttgcaacgtattctccaacgtttcattcagggtttctataagtgttttcatttcgatacaattttgatttgataaaatatgtatttactctcataaagcaaataaaaacctacgttttaatgctactaacaacttaataatcagttgctattaaattttattgtgaaaattcttaagattcttctccagaactgaaattatcctcccattgcatgtacaatttctctattaatcaataattgtacacatgaaaacattcaaatcgtcccaccgaatgctacaaagtttgaatactgaagagaaatgtagagagtatcttgaagagttgaggtggcatggtgagcctatttgcccacattgtggttctatttctaagcatcattataaactaactcaaaacggagagtttaaaggtttgtataagtgcaaggattgccgtaaaagatttacaattacaataggaactatgtttgaaggttctcatgtacctttagaccaatggttctatgctatttctattttcctttcattcaagaaaggtcttagcagtgcccaattagcaagatctatcaacgtaactcagaaaacagcatggtttatgttacaacgtattcgtaaaaacatgaaggatgatgatgcaacctttgatgatatgacacaaatggacgaaacctatatgggtggcaaaaccagtgcaaagcaccaaggacgtagaaaatgtaaagtttctaaaactggcaaaaagaatataggacgctccgtagcaactaatggaagaaagtatcattagtcccaattatgtaataatagtgggaaatgctggttacatagaaaaagtagaaatctaaaatagaaggagaaaatgcccaaaggtgcaactcgttttcttcatataatctcatcccagtagttgtgggataattcattaaaatatgaaaataaaaactttttatgtgatggtaatttgcaccagtttatcgttaattggatgtgacaaggaggaaatagatgcaccaataacacctcccattgaaaaaccagatgaacctattgcttcaccatctaccaatgacattattaaaattaaaacaggagatatagatatgataataggacacaaatgattggcaaggcgttacttatggtaatggaagatatgtagccgtaggatatggtggatatattgcatactccatcgatggagtgaactggacatctaagcaagtaactatgcatggaatgatattacttatggtaatgggaaatatgtagcagtcagtggtggtgtgattggttattcttctgatggcgtaaactggacagccaaacaagtaacaggcatgtggttatatggagtggcttatggtaacggaaagtatatagcagtaggtggtaatgaaagcattagttatatttgttattccacagatgatgtaaactggacgaccaaacaagtctcctgtcgttacttatatggtgctacttatggcaatggtaaatatatagtaatgggtgatggaggatatattgcatactccactgatggaattaattggacatctaaaatcgtaggattaattacttgggcaggtggtgcttatggcaatggcaaatacgtagtgattggtaataatggctatattgcatattctacagatgacataaattggataatgaaagggtgaccaggtaatagtgaattgcggcagagtattgtttatggtaatggcaaatatattgctgtaggctatggcggttatattactaattctacagatgctgtaaactggacaataaataaaatagaaagcgtacgcttgaatggagcctgcatttatcaatagaatgtttgcgctatgccataggtaattgaacttcatatcaaaatattagtagggcatgctgggaaactggcatgccctatttttgtcatattaatcgctattggggggaataagaaaataaaaggaattgttaatcaaaaagggcattgtaataaaagggagctatcactttattaaattatcaatcgtttgaattgtttttagtaactttgttctttgtatttaataactcattaacaatctaatatttatgtattatggaattaaaaacacttcaatacttttctcacaacttaacagatccaattcatgaagtatttcaagttttggataaccctaatcattcagaatataataagctactccatgatatgaaatctataaatgcagaagaactctctttatttgttattgaaaaacaaattgatttctacattaaagatagttttaatattgatatagagagaagggcttggtttctaatcaatcgtttgcatagggatattgcgagtaaaagactagatgaattatcaggaaatggagtgagacttaaaccctataactcgctcaatctgaaagagattttaatcaatgatgaaaatcttgttgacatttctttttttgatttgaagcctattggaattgttcataataactttggttatcgtttatgtccatcaactaatttagataattctacttattggctattccttgaaatcattaagcttgtacttaaaaacaaaaagaaattctatatcagattagatccgttcattgagatacctatcaaagattatactcccatggcatataaaatgacaattcatggaaagccactaaattgggaccgaattagaaatctgcaaaatgatgattttggacagtttataaatgaaaaagaggatagtgattatagtataaccgactatgtttggaatgtgaagaaaaacgaaatacactttacatgtgaagagttacctgcaattggaaattgcacaattagaggaagccgatatttccatgcgatttttaataaggatacgggctctattatacattgtgatggagctattagaatttatagtgaaagtgagcttgctgatagaatgagatttcatgttagaagttcagatgtgagaaaggtaggaaagagagtgaagatatttcaaacaaatgattctttaactcaggaggagttttctcatttagtaatgagttttttcgtctggaatcaagatgtcgtttcgtactttaatacatgataatacaaaagttatattgtaaatgcatgatatttatatctcattatattgatgtaaagccaacaaatactatgtgattatattatttgtaatgagaataatagatgtaataacgattggtacaataaagtatatagttgcgttttgattggtgatacgatgaagacgactatatcaactccttgttctgatatagtcttttccatcgaagggaacttggcatttacttcagaggacatatttaatcaacaagcacgtaatttctaattttttttttaaagtattgatcagaagattattgagtagcaataaagtcgtaactattcagccaaaagaatgtgtaaattcactcctttttattcttactattgcaacgatattgcactaattattgcgaaaaatgagcaaaacataaattgatgttttcgccacaatgcccctataagttatagatgtatgcaagctattgataatcaatggcttttccgattggataattattacaatgccatgcattagttaatattatataaaacaaaccaaaatcatacagtacatactgtaagtttcatatatttgcaaacaaacagtctattctgtcaattaaatacatttttagtaaaacgcatctgaatgagaacagactgatggtaaacacattgaagcaatgtttgtagaatgtctaaaattattttttgtattctaggaacacaaaaatataagtagtgtattcaaaaaacatcttgtgcataatgagatgattgtaagattgttgaagaattaaagagtaaaaattgtaagtccaattgaatcaatatttcaatgaatataatagaatattagttatcggtatcaatattacagacctaactttataaaaaagaatcagctgcataaatgtttatggaataggtctgataaagagatttttgaatttaagtttatttgattaaaaaaattaatgttatgaaaaaattaagttcttcaaagctggtattagctatgctttttgctgtaattagcatttctgctaatgcccaacttaaaatgtcctctaatggatatttaacttttggtcctacaagtacatataatgatggaaccaaagattataacattacactgagaggaaatatttggttggctggacccaatgtaggacatttcttacagatagacaccaatcctgctgcaactcgaatagcaagtcactatgaccaaattatattttataatacaggtacgaatacatataatagtattcaagtgaagaatgtatacaactactccgacttagcagcaaaaaagaatatccaaccattaggacgtagtataaatagtgtatctaaactgctacaactcaaacctgttaagtatgattttcaagacagttcagatcgcagtacttttaaagtcggtggcgatgggaaagaaattggattaattgctcaagaagtggaattagtttttccaaatctcgttttaaccgatccggatggaaaaaaattaattaactacacagcactaattccagttttaattgatgctgtcaaaacattaaccgaagaaattaatacgctgaagagtatgcagaaatgatctgctgtacatttttttattgacaatgcgaaatctttatctaagtgccctaaacactaaaggctccattttatttcattaacaattttgttcaagggacggaatggtgcctttagttattttacatccattacaatatgaaagaaagagttgtggaattggattatctgaaatgcatccttattttattaatggttttatttcatctagcttattttagtgagaaatatccattgctgaaacaattcgtttatgcatttcatatgccggtcttcttgatattgtcaggttatctaacaaatatcaataaaggaactaaaaaaaaaatccgggaaattttatggctcttcattccatattcattaatggaagcgagctatgtggttacagcatcagtcttacctattcgagaacattttgatggactcagcatagaacttttaattagaaaggtactaatggaacccatggggccatattggtacttgcataccctattggtttgtgaagtaatgtactatgtggtgtttctatttaagaagataaagcccatatcaagattttttattctagcagtttgcttgttcttgttatctcaggaagatttcaaattgttgatatttataaatgcaatatactttttagttggggtgtggatgagacaaagcaatttttcttttctgattatatttcaagcatcattctgggcaattttaccgttatgtattatttgttataatacggataactttagtagatcagagatgagtgggatagccataatttatttggcaacatgtataatcttggaaacacacaaatatatttccgggattctaaagaaagtcacttattttataggaaagaatacgcttgtgattctccttttctctcccatatttactattctgtccaagttattaatccctctattcacttttgatagaacggggatatgtttcgcatctgtttcagtggcttttgtcacgataggatgtattgctatttcatatatcatggattattttcatctatcaagatttttcgtaggcagagatcgaattcttaacagaataagtaattgattgataattattgtgtcataataatgaatgaaataaaatgaaaaaaaatgcagttttattatatggtttgttttcagcctttatgttgatattcctaacaggatgttctgacaaaatagaaaacattagtgatatgaatgggaatgaggtttctactcgctcactgtcctttactgattattattggtataatgggcaaaaaatcggaataaataaattgaataacaaaaagtatattctttttgatgagaataacgaaaatactttaaaaagttattctgcaacaactctgaagttcgtaaaagagccacaattgcttcaactttcaaataagataatgaaaaaaaagctgcaatcttcacccaaaaatcttaaatgggctacaattgaaacaacggcttcatcaccgaccttaaccaaactaaacggaataatttatgaagccccatattttcaaacagaaaatggaactgaagtaggattgagtcacttgtattatgtgaaattaaagtcagacaaagacgtctctaaacttatggaactagcatctatcaataaagttgatataataggtaataatgaatatatgcctttatggtatacattatcatgctcaaaagaatcgactggcaatgctttggaattagctaataagttttatgaaacgaatttgtttgaagccagtgaaccagacttaatgagtgatgacacacctaattgtgtcaatgactctaatttctcaaattatcaatggaatttaagaaatacaggtcagaatggaggaactataggagttgatgtgaatttttgtaatgccagaagtataactactggaagtcaaaatgtaattgtagctattgtcgaccaaggcattcaacttgatcatcccgacttaaatgtacattccatcagttatgatacagaaagtggaacatcacctagtagagtattgggcacccatggcaccaattgtgcaggattcattagtgcaaaaacaaataatagtattggtatcgcatccctcgctccagattgcccgtcaatgtcaattagtaattcattggcatcttctccggatagtagacaaaagagagctgacgggattaattttgcatggagaaacggtgcttctgtaatctcaaattcatggagttcaagtgttgcatattcaataattaacgacgcaatctcaaatgccttaacaagtggacgatctggaaaaggatgcgttgttgtgtttgctacaggaaatgactactcatcaacagtgggttatcccgctaattgcaatccagatatacttgctgtaggttctaataaccgaaatggttcaagatcttcttttagcaattatggcacagcattagatattgtagctccgggagaaaatgtatgcacaacaacaactggaagtaattattccacttcaataagtggtacctccttttcctgtcctacagctgctgctgttgcggctttagtaatatcggttaatcccaacttaactcaaaaacaggttgttgatattctagagaaaagcgcacgaaaagttggaaactatgcatattcgacaacgtctaacagattaaatggaacttggaataatgaaatgggatatggtttgctagatgcctatgcagcagtatctttagcaggcggcgagaatgtctattttaatgaccaaacggtatcatacactcaaacagtttctggaatgaacatcttttctcaaaatgttactgtaacgaataatgccaccttaacattcaattttattcaaactgttatcattaatccgccatttacagtaaatgccggatcgcagttcttcttatattactaaagttctagggtgcccagtttgatgttctcattttagagaagaatttaacagtacgataacaattgcattaagaatgtcaaactgaacaccctaacattttgccactatttataacttagataaggagcatctttcttctctgcctaactgattgtactttgcacgggcaagtattgtaaattttcctctaggaaattttgcataaaagtgaccaagagaagtattattcatttgattcgatagatataaataccatcagtataagtataaagtattaaaatatcatcatattgttcaatatcaataattccacctacacccaataaatcggcttgataaagtatagaccatgtatcaccaccatcagtagaatgatgaattgtaaatttatgttcttctttaggaatacgggtgactccagtagaatatagtatttgtggatttctcttatcataaattgttttgtaaaaatatacatcatccttcaaaacaggattccaaatccgacctttatctatagttttctttaaaaaatattcccctgaatatatcattatatttggattagttgggtcaaaagctatatgatgtatacaattatttctttcattctcaagtattatccaatctttcccatcattacaagaagcattaataaaagattcaaatatcatagtttcccctgtattgtaaatatttgtagtgtcttgaggatgaaatccaacaaaccaattctgatagccgccataaaaagtactgatagtcttccaactttttccaaaatttaccgatttcactactccaataggttcgaccaaagccaatagtgaattcgcattttgggagttttgagatattgagtaaggtatgacctttaactcattctcttcaattaaaaactccggtggcgttatcgccttacaagtttttccaccatctgttgaaagcacaaatgccttctcgtcagtgcaagctgtaattgcaattatagaatcccccttcataacaaactggattactggaagaccggagaacgcaaacttttcccagtccatgttattcaacgacttcgctggctttcgatatatccccgaccacgttgctatgcaaatatatccatcaactacttgaacagacggtctataaggacgcccataagtattccaaactttttcttgggcctctattacatttgctttatcttttaatccaatatattcaaaaatcttctcgtcgtcagtaatttctcgtaggttattatcatccttacaagaaataaacataactgataaaaacaaaattaaaaataatgatttcatttataattgctttataattagtctaagtggtgattacaaattaatttaaattatgcgtatattggtttgtctgcaggacgagtcaatattcattatatactaaaatcctttagaacaaacctttatattatctaaaatattattggattgattcttttcgagagaatccctataaacaaattgtttgaccatattaaaaatttaaatatagaaccaataaatgaaaaccagctatctatctggtagcatttatatagacactagtatagttaaacatttgcacactataatcaaataattgagtagcaagcacaatagcaatgcgttaaataaaaacattcatttcacagtatatgtgcatatcattgcattcttcacaatcattcataccaaataactattgcaaatatataataaataagcagtacatgctataaaacacagcctacttcttcaagattaactagtattagtattttcaacgtaaatttagtgccactcgttgccacccaatgcgcaattctcattaggaaactacgtatatcagattgaacgtgtagctatagtcatgtgtgtataatcataagatagaaaagaagaaaaggctggcggcataatcagcgctaatacatgaaaaacggaaaagtttattaacttcctgctaaaaggcaggcccctacatcatgatttcaggatgtaagatacagatatgtaaataatattatcaaaaaaggaagaataattgagatctgtatataaaaaatgaagagaaaaatctctaaaaattaatattatcctattcatttatagaaaataaggacatttacagaatacccctaaataaactacaacgagtggcaacagcgtgacggcaaattctgccatcacactgctgtcactcgttgccgtcaccatatttatacctaaaaatcagcctgttacatctaaaacagtgacaggtgacagataatatttgtttttatttatataggatgaagaaaatatagatgctactgatattatttacagataaacgtaaccaacaatcctttgtgatcggttggccatacatcaagcggcaataagaacttatctttggatgtctcctgcacgcgctgtgcgcggacaatagaacctttcggtccgaagatgaccgccttccttgcatccagtccttcgcctttatagaaaataaagtcgatccggtcccgctcgtctgctttgggagcccatgtgattttctccggagtttttgccggattgtccgaaggataagtaaagccgggatgtgtcaagggattgggatatatcttgcggtaactatctacaaatccggcttcttcgagcaaagtcgttaccgtccagggcacaacgaagccattgtgatcgtacatatctttattcttctctatccagtcacggtgagacggttcgttaaagtcaccgccgataatcactttataccctgctgccaggtctttctcagcctgagtgataaacaaacggatagcatcgtcacgctgggaagcaacgtttactttcagtatctcttctaccgatgccggcaacggtatttccttccaggtagaaccgtcatagccgcgggcattgtagtatgcacaatccagataatccagatgtgacgtgtaaaccgctaccttatgcccgtttaccgaactggtcaggcgatagatacttccgtgatcgtctttctcgggaaaaacagtcagggaatcggtgataggatgtttgctcagcagccccgtgtcataactataaaaagaataatacgaaagccccttctctttcagcgaagcacagacgcgggctgtgaaattcgtcttattgtaattcctgacttcactgaaagttacaaagtccggtttcaggcgaacaatctcattgacaatagcgtcatatcctcccggtaccatcgtaccttcctgccatacattccattgcagtactgtaaattcattactcttctgacttcgtgcaaagacggaaacaaatagtaaaagtgtcgtaaatagtaagttggttaatcgcatttcatttattatttagcgtgatgtatctttaaatagctttccagaaagactgaaaatcacggtatttaccgtagcagaccagttcgtctccttcttccaccttctcatctccgggcaactcattcttgacatgacgctccatcaaagaaatgcccaggcaattagtgactttgttcgcacgcttcagtgcgatcagtttcagatgaaactcttcatccatattcagctcattcacaaagtatcctacaaacttcttcggaacagtaaacttcacgacataataatcctgatcaatacggaacgcttccatcgtcgccccaaagtcgagcaactgcaccaggctacgggcagcatcctcttccggtgtcagaatcttctccagactaaacgcttcaagcactgccttgtgcaccgcatcaatggcacgggcaaaaatacgaggcacctttttctgcttcaacaacgcgacaacacgtaccgatgctccaaaattctcgccaatcgccacaacaacaatatctacgctattcaaaggcagcaccgacaacgactgttcgtccgtagcgtcaatgacaaaagcagtggcaaccttatctttgattgagtcgacacggctttcgctgatgtccgctccaatgatctcatgccccaatgccgataattcctcggcaagtacatgcccgtaatttcctagaccaataataatatacttcatgatgttagtttatgatgatgttatcactcggataacggtattttgtattctttttctgcttgacgatgcccagcatcaacgtaatcagaccgacacgtccgataaacatcagcaacgataccagcaatttactggcatcgcacaattgaggcgtcagattcaggctcgatcctaccgtactaagggcggaaacacattcaaaggtcagtgccagcaaagaggctttcggttcgagtatgctcaatatgaagatgaagagaaacaatacgcccagcgacatgacgaccgtcgcattggaacgccggatagagtcatgagacaattccctgccgaagacctccacccgctcacttccccgcaatacggctacaaggttcaacactaccactgcaaaagcattcactttgacaccgcctgccgtagactgcgaaccgccgccgacccacatcaggaagagataaaccaacagcgtctgcacgctcaatgatgccagatcgacactgctaaacccagccgttcgcggacaggtcgcattaaagaatgcttgcgtccatttatcggccacagacataccggcaaaagaggcattccactcaaaagcaaggatggccagtgtaccgatcagcaaaagcaggaaagtcatgatcaatacgattttcgtattcagattgtagaggtgctgcatcttatgtctttccagtttgcgggtacgcacaaacgtccagaaatggcgcaaatggtataatacgatatctttgaaattaaccagaatcggaaagccgataccgcccaagataatcagtaaagagacggagatgaacagccagttgtggttggtcatcaccatcgaatttcctaaattgcctgaaagtgtggagaaacccgcattacagaaagccgaaatggaatggaaggcggcaaaagccagttcctcttccagattcatcccaagcgtatcgtgaatgctgaaccagatggacaccatgccaatgccttcgatgaccaatgtaaatccaaggatatatagtagtgtggacagtaacgaccccaacgaattggaactgaccatatcacggacaacgagctgattgtaaatggaagtatttcccataaagaacatggcaaagaaactggttaatgtcatcactcccagtccgccgatctgaatgagcaggataatgactacaagtccgctggtggtgaaagtggtggatacgtctaccggcaccaagcccgtcacacagacggcactggtggctgtaaacagagaatcgacccaagtgatgccattgaccgtacatcgtggaagcatcagcaatcccgtcccgatcagaataatagccataaagctgacagccagtatcaaagacggattcgtacggcgtcctaaaagacgcaccaagccattggacaggttcagcagagaaaaaaccaacaataatattaaatgataaaacttcccgtgaaggaattcccagacttgcagaattgctccctcttcttccggacgatggaagatgacgggaaccaaagttaggtaaagcaatacgctcaatatccatgccaaccttcgatattgctttttcgtattccggtattccagcgaaatatgcagggtaacatcaattaaaaagataatccatacggctttatacaagatctgtatctgctgtacctcgaccggggacaatggaaaaccatgttcgtaaaccactccgacaatcaacaacagagatgccagataagtgagcgcttctaccaaccccagcaggatacgtacatagggcttgagaagcttattctgatataacagaaatttatgataaatcttcatatcacatttttttattgtcgtatttgctatgccgtgcaaacttaactaaaataacaatcgaattcgattctttgttgacaaaattacacgaatattaaaaattttgcctacttttggcagcagaaaactaataaaccacaataacatgagtgacaaaagaaaacggtatatcctaccggaagaagaaattccacattactggtacaacattcaggctgatatggtgaacaagccaatgccgccgttgcacccgggaacaaaacagccgctgaaagcggaagatctgtatccaatctttgccaaagaactgtgtcatcaggagcttaaccagactgacgcatggatcgaaataccggaagatgtacgcgaaatgtataaatattatcgcagtacgccgcttgtacgcgcttacggactggaaaaagcgctcggaactccggcacatatctatttcaagaacgaaagtgtcagcccgatcggttctcataaactgaactctgcgctggctcaggcatattattgcaaagaagaaggcgtcacgaacgttactaccgaaaccggtgcgggccaatggggagccgccctttcttatgctgccaaagtttttggtctcgaagccgcagtttatcaggtaaagatcagctacgaacaaaagccttaccgccgcagcattatgcagactttcggcgcacaggtcactccttctccgtctatgtctacccgtgcgggaaaagatatcctgacggctcaccccacctatcagggttctctgggtacagccatctcggaagctatcgaacttgcacaaatgactcccaactgtaaatacactcttggttcggtactcagccacgttactctccaccaaaccatcatcggtctggaagctgaaaagcaaatggaaatggcgggcgaatatccggacgtagtaatcggttgtttcggaggcggttccaacttcggaggtatctctttcccatttatgcgtcacaacatcctggaaggaaagaaaacccgtttcgttgctgccgaacctgcttcgtgcccgaagctgacccgcggtaaattccaatatgacttcggtgatgaagccggatatactccgctgctcccgatgtttacattaggacacaacttcgctcctgcccatatccatgcaggcggtcttcgctatcacggtgcaggcgtcatcgtctcccaattgctgaaagacaatctgatggaagcggtagatatccagcaactggaatctttcgaagccggctgtctgttcgcacaggcggaaggtattattccggcaccggaatccagccacgcgattgctgccgctatacgcgaagcaaaggcgtgcaaggaaacaggagaagagaaagtgattctgttcaacctgtccggacacggtctgatcgatatggcatcttatgacaaatatctggcaggcgatttagtgaactacgcactgactgacgaagatattcagaagaatctggatgaaataggagacttatccaagtaagccccggtttctgaaccgaattctgtaagcataaaagcccggtatgatgccgggcttatttattatctctacgaaactatccaaaagaatacagtcttttgtactttattcatggggtatttaaaggaaattactatctttggcgtcattattaatctcgtgaactaataatgagcaagcttaagaagatagtaatctacttgtttttcctatgcttaggaatgcattccgccttttctgaaactccggaacaaatcacattttcctatatttccatcaatgagggactatcacaaagtacggtgttctccatcgatcaggataaaaggggcaatatgtggtttgccacttatgacggagttaacaaatacgacggatatgcatttacggtttatcagcataatgaggatgacccgaacagtatcgccaacgacatctcccgtattgtaaaaacagacagtcagggacgggtatggattggtacacgtgatggtttgtcccgttatgatgaggaaaaagacatattccagaacttcttctatgaaaagaatgggaaacatttgcaagttaacggtatcgaagagatttcaccggaacagttacttatcagtactccggaagggctgatcatgttcgatatcaaagaatccaaatttatagatgattctttcagcacagcgatgcataagacaatcgcctccactctttacagacagggtgaccaaatttatatcggaacttcgaccgacggactctatacttactctattactcagaaaacttttgaaaaagtgatccccattttagggactaaacagattcaggctattcttcagcaatcccctacccgcatctgggtggcaaccgaaggagccggactgttcctgattaatccgaaaacgaaggaaataaagaattatctgcattctccttccaacccgaagagtatcagttccaattacatccgctcactggcaatggattcacaaaaccgtttatggatcggaactttcaacgacttgaatatttatcatgaaggtactgattcttttgcctcgtacagcagtaaccccgtagaaaacggcagtctgtcacaacgttcggtgcgcagtatctttatggattctcagggcggtatgtggctgggaacttatttcggtggtctgaactattatcaccctatccggaaccgcttcaagaatatccgcaatattccttataaaaactcgttaagcgacaatgtagtaagctgtattgtcgaagataaagacaaaaacctgtggataggaacgaatgacggaggattgaatctttataatccgattacacagcgatttacatcttatacactgcaagaggatgaaagtgcaagaggcatcggttccaacaatatcaaggcggtatatgtagacgaaaagaaatctttggtatatataggtactcatgccggcggactgagtatccttcaccgcaacagcggtcaggtagaaaactttaaccaacgcaacagccagctggtaaatgagaatgtctatgccatccttcccgacggagaagggaatctttggttgggaacactcagtgcactggttcgttttaatccggaacaacggagttttactacgattgaaaaagagaaagatggcactccagtcgtctccaaacaaatcacgacactattccgcgactcccataaacgcttatggatcggtggagaagagggactatcagtctttaagcaagaaggtctggatatacaaaaagcatccatacttccggtttccaacgtcacgaagctctttacgaactgtatttacgaggcttccaacggaatcatctgggtaggtacacgcgaaggattttattgtttcaatgaaaaagacaagcagatcaaacggtataacacgaccaacggtctgccgaataacgtagtatacggtattttggaagattccttcggaagactctggttaagtaccaaccgggggatttcctgctttaatccggaaacggaaaaattccgtaactttacagaatcggacgggttgcaaagcaatcagttcaataccgcttcttattgtcgtacgtctgtgggacaaatgtattttggcggtatcaacggaatcacgactttccgtccggaattattgctcgacaatccttatacgcctccggtggttatcaccaaactgcaactgttcaataaggtagtccgcccggatgatgagaccggtattctgaccaagaacatcagtgaaacgaaaagtatcacactgaaatcctggcaaactgctttttccattgagttcgtggtatccaattatatctcaggacaacataatactttcgcctataagctggaaggttatgataaagaatggtattatctgacggacagccgcaccgtctcctactctaacctgccacagggaacctatcaattccttgtcaaagctgccaacagcgacggcaaatggaatcctatccctacagcattggagattatcgttctgccgatctggtataagacctggtgggcactactcatcttcttcgcaaccttcgcaggtttcatcacttttgttttccgcttcttctggatgcgcaaaagtatggaagcccagcttgaaatagaacgcagagacaaagaacatcaggaagaaatcaatcagatgaagatgcgtttcttcatcaacatctcgcatgaacttcgtacacctttgacgctgattctgactcccctgcaagagatcattaacaaaatcagcgaccgatggacacgcaaccaactggaatatatccaacggaatgcaaaccgcctgctgcatctggtcaaccaattgatggactaccgccgtgctgaactcggagtgttcgaactaaaagcgaaaaaaggaaacgctcatcaactgatacaggacaacttccttttctacgataaactggcacgccacaaaaagattacttatactctacactctgaactggaagacaaagaagttctttttgatgccaactatctggaactgatagttaacaacctcctttccaatgcctttaaatatacggaaagcgggcaaagcattaccgtaactctgaaagaggagaacggctggctattgttgcaagtcagcgatacaggcataggtatccctatcaacaaacagggaaagatattcgaacgtttctatcagatagaaagtgagcacgtaggaagtggtatcggactttcgttagtacaacgtctgatagaacttcatcatggacgtatcgaactggacagcgaagaaaacaaaggcagtacattctctgtctatctgccacaggatctgtcggtttacaaaccttccgagttagcttccaataacgaacaaaatgaagaagagcaagtgtattctaccaattcgaaagcaatgtatttcatcgacacggagaaagtggaaaacgaatctgtggaatccggtgataagaagcgcggaacaattctgatcgtagaagataataatgaaatccgccgttacctgagtaacggactggcggatttgttcaacacactggaagccgggaacggtgaagaagcactggaaaaactgaaagacaacgaagtggatgtgattgtcaccgacgtcatgatgccggttatggatggtatcaagctatgcaagaacgtgaaacaaaatatccggacttgccatattccggttattattctctccgcaaagaccgatatcaaagatcagatggaaggtctgcaaatgggtgcggatgactatatccccaaaccattctctcttgccatcctgacaaccaagatacagaacatgatgcgtacacgcagacggatgctcgataagtacgccaaatcattggaagtagaacctgagaaaatcacattcaatgcaatggatgaagccttgctgaaacgtgccatggcgattgtggaaaagaatatggataacatcgaattctctaccgacgaattcgccagagaaatgaacatgagccgttctaatctgcatctgaaactaaaagcaattaccggagaatcaaccattgactttatccgtaagattcgtttcaatgaagcagccaagctactgaaagacggacgatatacggtagcggaagtcagtactatggtaggattcaatacaccgtcatattttgccaccagtttcaagaagtacttcggatgcttacctacggagtatatcaagaaatcaaaaggataaccttctcattcaaggaaagtatgttgttagacaaatttgatatataattcattaaaactaatagtagctaatttgtttttgaacaaagtatagacgttatgaacaagtattggctgtataactctctacatttgtatagagatatcagaaccaaaagaatataaaccacattaaaggaaatgtttatactatgagcttcaaaaaacgactttacatctatgtaattttatcattcatcagtatgggtatagttaatgcacgttcaataactatacaacaaacaattgactggcccgaattcatgagcagtcaggatatgatatgggaagtactgcctgaatattggcacgaatcagcctatctgggaaatggcaggctgggtctaatgatttataaagaaccggaaaaaaactacatacggttcgaaaccagtaactgcgatgtacacgaccacagagaaaaaagagacgtattcgggacgccccgattactcaccggtcactttgcattacaccccgaaggggaaatcatcagtggtaagatgcgcctcgacctttggaacgcagaagctacaacagatattgtcactaccaaaggagcgatccatttaaaaacgtttgttcatgcagacgatatgattatgatcgtaaaagcaacgacagaaggagaagaaaaagactttcagtgggaatggattgccgccgaagctaatagcccccgctatcttttcttcaagaatcaaggtaagatggacaaaattccgcaagactatcaactcaatcctgctgctgaaatcagtaaaaaggatgacataaacttatccacccaaaagttacttgccggtggtgaaacagtagtaggatggcaggaaagtaaagctgaaaaaggagaacgcattctgtggataaaccttacacatacatttccacagacaaatgccggagaaatatgtatgaaagaaataaagaaagccgggcgtcaaggatttaaaaagctacaaagtacgcatcgcaaatggtggaatgcctattatcctgccagtttcatcacattgcccgaaatccaaaaagaaaacttttactggatacagatgtacaaactggcttccgctactcgcggtgaccgcgccttgatagacaatacaggtccctggctgacagaaactccctggcccaacgcctggtggaacctcaacgtacagctaacctattgggcattgaatgcctctgaccatttagacctggccgcctcactcgaaaacgcactttacaaccatatagacgaactacgcctcaacgttccttctgcctaccgttctaattctttagggattggagtggcttccaatctggaatgtatgtcaacggaaattggtattcccggcaaaggtaaagcacaagtaggattattaccatgggcatgccataacctctggctcatctaccgccacaagatggatgataatgtgttacgcgacaagttattcccattattaaaaggtgctgtcaactattatctgcacttcctggaaaaaggcgaagatggcaaattgcatctccccaaaacctattcaccggaatacgatgccgtagaagactgtaacttcgatctcgctttgctacgttggggatgtcagaccttacttgaatcagcaaaacgtctgaacattcaggatcccctgatggaaacttggcaaagtgttctttatgatctggtggcttatcctatggatgaaaacggcttgctaataggaaaagacatgccttatgccttttctcacaggcattactcacatttacttgccatctatcctttatatctgctcaacactgaacaaaccggtgcggttaacatcatcgagaagtcgctagccttctggcaaagtaaacccaaagcgctccaaggttattcatgtaccggtgcttcttctatctcgtcagctatcggtaagggaaatgacgcgcttgcttatttgaataagttattcggaaagtttcttagccctaccactatgtataaagaagcaggccctgttatcgaaaccccattatcaggtgctcagtgcattcacgatatgttgctacagagttggggaggaaaaatcagaattttcccggcagtgccggatgcctggcaggatgttgcctactccggtttacgtacagaaggagccttcaaagtttctgccagcagaaaacagggaaaaacagaattcgtgcatataaagagcctggccggcgagccttgtatagtgatgaccgacatctctaatcctgttttcaccggaaagagagactttataataaaatctgtcgataatggtatttatcagattgacttaaaaaagggagaagaaatcatcatgtatcctaaaggtacatctccagattttagtatctcacccatatcacatatgtctcaaaactattttggaaagaaggcaaaataacctattgagatcagcatgtaaaagagctgcttgaatgaattttaaaatcatccatttaagcagctcaaattgtacaaaaggtatcttatgacactatgtagagatattacattctgatatctaaaaaactaaaattcagagacaaaaccacctttttgaacaaaaatagcatatgtctcaacaaaattaatatcaaaaaagtcatttttgaacaaagtgtggacaacataaattaagaatcatatttaatgaagttacatttgcaacagtaaaaatacacttttaataattataaaacctaataaagtatgaagaacatcttctttatttgcatttgtgccttattcgcttttaccggatgcacggatgacgatgatgaactattggcaaatggagacactaacattaacttacttcctaatcctcaaccgaatggcgtaattaatgaaaagttattcgaggttatcaacctggattatccgggtctggaaaaggtgaaagagtattatgaagctaatgagtattattacgctgctcatgagttattaaaatactatagaaacagatcggatatcagcaacccgaatatcaatctgatcaacccttctattactacttttgatcagaacatagctgatcaggcattggaacacagattctatgtacgtaacttcaaagaaaaagaagaaaacggcaaggaagtctattatttatttgataaagataaaaagatagactggacttatattcctgctgaaattacagaccaggaatttaagtctcagacccaccgtcatcaatggatgcttccacaggcaaaggcttaccgcgtcaatcagaatgagaaatatattcaatcatggatagaggtttatagtgactggctgaatacctttccttgtccggaaggtacagtaagcaaagatgctgtccagtggtatggtctgcaacctgccgaaagagtgcttgaccaaatcgatatcatgcctcattttatccaatctaccaactttacccctcaatggctttcaacattccttgttgcttttgccaatgaagtagagtgcattcgcaacaactattatactgacggtagtaatatttatgttacccaggtacaagcaatcactacagcaggtattttaatgcccgaattcaagaatgcagaagcatggctgaatgaaggagcacaaaaaatcactgaacagattactgcacagttcttagaggacggagttcaaaatgaattggacccaagttatcatatcggagtagttgcaggattctataatatatataaaatcgcccaactcaataacaagttaagcttattcccttctacctatatagaacagttgagaaaagcagcccgctttgttatggatatcatctatccggactatacaattgacaacttcaatgatacacgttctgcttcatatactaaaaatgtattattaagaaatctgagacagtattctgaaatgttcccggatgatgcagaaatgaaatggatgtcaacagaaggtaaacaaggaacaacacctgccggtttgacacagatatatgatgcttccggctattatatgttgcgtagtggatggggaaaaagctcgactatgatgattctgaaaaacaataataatccggataacaaatggcactgccaacccgataacggaacatttggtatctatcgtaacggacgtaatttcttcccggatgccggtgtatattcttatggaggaactgcagaaagcaatgcggaacgcaacgcgtacctcgctactaagaatcataacacaatgacagccttaagtgcaacaattgccaacgggtatatgaaaggcgagttccttaaacatgagactaaaggaaacacacagatcttggttactcagaatcaaattaaagccggtcttactcaccgccgggctgtattcttcgtagataaagagttctttgtacttgtagacgaaggatacggagatggtaataaagacaaaatcaatttgaatttccatctttgttcaagcgaagctaatgaaacagcatatgatgacttatccgcttcttatcagtatggcgcacataccacatttgcaaataataacatccttgtccgcacttttgccgagacaaaccaggattttgacaaatcaaatgttgcatctgatgtttccaataagttaggagaaaaaaatgcgtcacgcaaaggttatcaatataccatacgaaaacctgagaatggagctgcccgctttattactgtaatctatccgtttgaagctgtttctacacttaataatctgactatggatgctcagtttaccgataatactcctgaagacgcaggtacattccatacaaatggtgctgcggtagaagtaactatcaatggcaagaaatacgaattatcttatactttataatttaatatacctaagaaaaatgagatctaaattacaaaacattacttcaagattgctggcaatcttaatggtagttggattgtgtgtcacggactcctcctgcacggatccggagacaactgactctaccaagtttgcgattttctatgccggtattaccgacataggcccctctatgaatttcaacatgtccggaccgacttacatcggaggtacaccctcagatttttctatcactcgcattactcttgatggagaagtatacgatacagattgttttcaaatttcagatcctagtacaggagctattaaattagctaatacggataatctgcctgtcggcacttactgcatcagtgtatcttgtatatcaaatggaaattattacgagtttaaagatgtaatcactgtaaatatgctggcaccggttcctgacggaattacagtagacccaagcgaagttacagtagattttgcagacatctataaagagtctgccagtgctcaggtaaaaactgaagaaggaacacatgtacacatcagcaagtatgaaatcattcaagaagaaggaaaggaatactttgctatttccaataccggaaaaatcacagtcaacgataaatatgaaggagaaattcttcctggtaaatatgtgttgaatcttaaattaacaacagaagcaggagcaggtatatacgaaaatgctgttacattcaacatcacttccagtccgcttacgttaacatacaaacccgcatcggtgagagtagaaaaagatcaagcatatgtgtccggagctccaattctcaaaggatctccagaaggactgacgtataagataaaatcaatctctcccgaaacttcaactatatctatagatgaacagaccggaatcataacccttgccgccaataacggattagaaatagataatagctataatgtatctgttacagcaaccaaccaatatggcagcaaagactttgataatacatttgttatcaatatagtggcattcattaaccctattacccaacttcaatatgcaaaccaggaaaagatacaatctgttgcatttgaatttggtccggaagaagtagatggagacgaacttacttactcattcattgacttggactccagattagccgataaacttaatattgatggagttactggtgttatttctgcaaaaaaaggcaattcaatagaaactggcacatatacaatcacagtacaggcgaaaaatgacaagagtgagaagacttcaacctttacattgactattgcagcaaatcctaactatttcacttacatacgttatggaaataacctgggacttacccctgaagaaaactatgctgatcaatttgattatgacaaaaaagctattcttctagctgaaaagttaactcctaagacagacattcccaatggtcgtcccgttaaatgggaagttaaaatattaaatacaactgcattaagtggtactacaatctcagaaacaggagaactatcatttagtgagaataaatggaatagcaattatggtgttagtgtactttttgtaaccgcaacggtgggttctggagaggaagctatatctaaaacaattcctgttttcatacgtcaaaataaagataaaaacggaattttcgtcaaatatactccatttgcagtaaagatgaatccttctaaaggtggtatgatagctgcacctgtagttacattaaatggcacaactgtaacagattacacaacatatttaatggattatcgtagagacttctattactatagtttcattgaaaaccatgtagacggaatacagtcagtcaatggtagttttatgaatggcttgtggacaacatattataaagcaattgggaaaactcctaattatagtgcaagagctcctatgtcctactacgataatgcccaaaatctcagtcaacccttaggctatataagcaacaaagatctatctgtaacaatcaaccctggcaaatggaaagattctgaaggagtgtatgcaaatggtgtttttataggaagaatgtcttttgtaactgacggtaaacaggcagatctcgctaatgatggcactaccaaaaatcaaatattcccattagccatttggtttgatgaaagtttctaatttaaatctaatatagaatagatatgtacaatataaaatttaaagcattgagtaaaagagggtattttaccctcttagctctcttaattgcgattacctcatttgctcaggaaatcacaataaacggtgtcgttatcgatgaaacggatactccattaatcggagcaacggttcaagtaaaaaacactcaaaaaggagtagttacagactttgacggaaaattctccattaaagcgaatagtaatgcaacattgattatcagctacattggctataagaaccaagagatcaaaataaaaggtcaaaagaacttgaatatcaaattagaaccagacaatgcaatgctggacgaagtaattgtagttggttacggcagtatgaagaaaagcgacttgacaggatccgtttcttctgtagctgcaaaatctattgaaggtttcaaaacaggttctgtagtagaagcacttggaggtcagattgccggtgtacagatcacccagtcggatggtactcccggttcgggtttcgatatcaaaattcgtggtgtcggtacagtaaacggagattcttctccactctatattgttgacggattcgaagttagtagtatcgactatcttcctaactcagacattgaatcagtcgaagtattaaaagatgcttcagcttctgcaatttatggcgcacgcgctgctaatggtgtagttttggttacaacaaaatccggtaaagaaggaaaagccgttatcacttataacgggtcggctacttatcgtaacattcctaaaaaactggacatgctcagcacatatgagtttgctgcattgcaagtagaactcaacccgactaaatacggaactacttattatcaagaaggaaatgattctgacggagttccttatcgccatcaaactttggaagactacttaacagatcccggaattgactggcagagtgaatcattcaagccgacttggtctcagaaccatgatttcagtatcagcggcggtacaaaagaaactaaatatgccgcctctttctcacattttgatgaaaatggtatcttcacgaacagtggctataaaaagaatgcaggtaaattacgcatcaaccaaaagattactaaattcatcacttttgatgctactatcaactatgcaaatacggtgaaagaaggcatcggtacttcaggtaccggaggaacactaaatatgttatcaaatatattacgtttccgtcctaccggaggtaacaatgtaacaaacgatgaacttctgaattctgtttttgacccattggaattaagtgaaaacaccacttattcacaaattaatccaattaaacaggctgaagctgtaaaagaccggagacaatctgaattgtggggagctaatgctgcactgacagtacaattgatgaaaaacctgacattcaaagcatcagccacttacaatacgactaataccagaagggatcttttctatggtgaaaactccagccaggcatatcgtagtggaggcgtttatggttctacacaaatgcagaaagacttacgttggcagagcagtaacacattaacttataaaaagaaaatcaataagaaaaacacgtttgatatcatgttaggacatgagttttcattcagaagctcggaacttttatatggacaatccaaagatttcccgttcccaaacctgggtaacgacaatctgggaataggagccactcctagcagcgtatcaacttcaagaagcgacaagaaactgttatcttactttgcaagaggtaactacaacttcgacaaccgttatctatttactgctacaatacgtgctgacggttctaccgtattctctgcaaaaaataaatggggatattttccttcattctccgcagcatggcgtgtatcggaagaaaaattcatgaagaacataactccgatatcaaacttaaaactccgccttggatggggtacagtaggaaatgaccgtatcacaaactatctgtctatggatctgtattcatcaagcaaatatggaataggacaacaaatggccacagtgctgagtccgaaacaactggctaacaaagatctgaaatgggaaggatctaccactgctaacttaggtattgatgttggtcttcttgataaccgcctgaacctgacagcagatttcttcttaaagaacaccaaagatctgttacttgaacaaaagcttgcttatgtaacaggattcaactctcaatggcagaatattggtaagattgagaataaaggtatcgaattgaacatcaattccactaatattcaaactcgtaacttcttatggcagacagatttcaacatttcattcattaagaatacattgaaagcgttgcaggacggcaatacatatatacagtcagcaactaaattcaacagtaacttcaatggaaatgattatatctccattgtaggttcttcacttggacaaatgtatggatatgtttttgacggtgtttaccaaacatctgatttcaacgtacttcctaacggttcaatgcaactgaaacccggagtggcagatataagcaaacatgccggtaagacggtggaaccgggtatggtgaagtataaagatatagatggagacggtgtcattactcctgacgaccgtaccactattggaaacggccaaccggattggtacggaggtatcaccaacaccttcaattacaaaaacattgatttcagcttcatgttccagttccaatatggcaacgatgtttataatgcgacgcgtatgttcaatacacaatcgcaagacgaacgaagtaatcaactggcagaagttgccgaccggtggactccgacacatgcatctaatcgtgtgccttccgccagaggatatgtaaaatatgaattatactcacgtttcgttgaagacggttcgttccttcgcttaaaaaacataacattaggatatacattccctaataaatggacaagaaaagcatatatcaaccgcttgcgtgtatatggtacagctcagaacttattctgcctgactaaatatagcggttacgatcctgaagtgaatatgaaaagcagtccgcttatgccaggattcgactggggtgcttatccgaaaagtagagtatttacatttggtgtagaagttcaattctaaacaaaaaaaagacaatgaaaaagttcaaatactacttatgcacattagcctgtgcaatcaccgtttcatcttgctcattagatgagaccagctatacagaaattgagaaaggaaactacatgaagaatgcggcagaagcagaaaatgtacttctgggcgtatatcgtgatatggttcaggatggtatttatggtttccacctatctttgtactttactatccccagtgatattgccaaagtaacaggtaacagtaccgacggacttcgtctgattccctcaaacgcttataccagttcacagacagaaatagcaacaacatgggcaaacctatacagtgctatctatgatgcaaacgattttatcgagacactgggacaaaaaatcggaacctacgatgaaggtaattacaagaaagccgctgtctatatggcagaagcacgttgtctgcgtgccatgtactatttcgaattagtacgttggtttgggaatgtagcattgataaccaatactgctcaatcccgtcaacatccatctactttcacacaagcagatcccgcagacgtatataaatttatagaaactgatttgcaatacgctattgataatctgccttattcagtggatgacaatatacgttctgacaacagtttccgtctttctaaaggcgccgcactcggactgttgactaaagtatacgctacttgggcaggctatcctgtccatgatacaagcaaatgggaaaatgcagcaaaaactgctaagattttagtcgaatcgggtaaacatcacttgctttctgacttcgaacaattatggaagaacacttgtaatggtgtttgggatgacgaagaaagtctgatcgaagtaagtttctatgctcctaccgttaccggagtatcagctaatgacccttgcggacgtattggtaaatggaacggtgtacaggcaagcggtatcagaagcgtccgtaatgccggtaactggcgtgtcatcccgactttcctgcgcgactggaaagaccgtgaaagtgataacagatggaagtactcctttgctgattacaaatatggtaaaaacacgactaccggtgaagatggagtcaaacttgtaatcaatgccagcggtaatattgaagatgccatcaaagacgatgctaaagatgcattaaagaaatcctatatcgataatgtatgcccgagaaaatgggatacagaagaatatgtaaacagtgccaactatcttatcgatgctaatctttccaatatcaactggtatatattacgttatgctgatgtattacttttatatgcagaagctttgaacgaatggaagcaaggaccgaccgacgaagcatataaggctatcaatatggtacgcagacgcggcttcggacttcctgtggaaaccgacaacagcgcctcagacttatccggattgtcttacgacgaattccaaaaagccgtacgtaatgaaagagcttatgaattggcattcgaaggacatcgcagacaagatttagttcgctggggaatctactacgacagcatcagaaaaacagctcaggatttagttgactggtatagtgccggtgacgaattctatgtatgcgtcgattatactaaaaagaataagaatgagttactccccataccacaacaggaaatggacttgtgtactcaattcaatcagaatccgggatggtaaataatcatactgtaatataacatgaaagcgttaccgaagaaatagtctttcttttggtaacgcttttatcataattctttatttcactgatttctatataccatgaaaaagaatcttagcatagtaattcttcttatatctttagccatcagtcaatcggtattctcccaaacctattcatttgagaagggaaaagtgcccgaaggttggaaaatagataaaggcgtgctccatatttcctctgagaaatacaaatcaggcagtcgatcacttcaaatcaaatggaaacagaacgcagttctcactatcccctcacctaccggtatttctgaagcatgtagaaacagaaatggtggtatgaacgcatggatctataacgaatctcccaccaaagagaatttactgttttccttcagagatgagactggtaaagaagtatgccaacttcccttcttacttgactttaaaggttggcgatgtatttgggctaaatttcaaggagacatgaatatgtcatccaaaagtaatattcagtcagtcgaaatacaattcccacagcatacaaaaaaaggagttacttacatagatcttttagagttcacgtctaaagtttcctggcagaatatgtcggatgcacaatataaggtgaaccgtactgactatagtttaatacctgacttcattggctatagaaatgctactccaaaagtagaaaaagtaatcacagccgaagataatcagattacaaccatcacaaacagattaacaacctggtatcttggcagcgggcaacattcatctgagagatggataaaaatgagaacggaaaatgaaaagacatttattcggaatggtgtgaaagctgcccaaaaaatcaaaatccaatataccgaagatcatactcctcaaggagaaccattattcccgatgggggcacccactatcatagacggacaagaagctaaaaagttcaggagcattaatgaaaacatcctgcttccattggcactggattatcgtaaaaatcaaaatgatcaaagcctgaaaaaagcactttacatttatgattggttcaacgaccaaggctgggcagacggcagcagtatgggaactttatgttttgagaaacttagaagttccggctattttcactcattctttttgctcaaagaacaattatctccggaacaactaaaacgtgaactccaaacgatgaactggtttaccatgttcggggcatgctatcagcttccttcacatgccggcgaagtagcagataacttacgcgcattggcgattccaaagctaatatacgcgctatcacaaaatgataaacaagaaagggaagttgccctgactgcattcaagcattatatggacaatgcattaggaatagctccgggatttttcgggacgttcaaagctgacttctccggatatcatcacagaggttcttatcatagtgcgtattaccctcatgcactttatgcaggtgcactcattgcttatttactgcacgatactccttatgcactgtccgaaacaacattgcataatctgaaacaagggttattgaccttccgtttcttttgcgccgatctggaggtacctgccggaactgtgggacgtttcccaaaaggacaacagattttagagaccttattaccggcttttgcctatacagctctgtcatttaaagaaccggataaagaattaacagctgccttcaagcgaatacttgaatccacagaaaaccaacaggctatcactgaatatatcagtaacgtgaattcaaacttagcatataccagcaccgtaggagaaatcgagctagtaactcaattggcatcaagttccattgctaaagaaaagcctgtcaccggtacactgttcatgccttattccggattattggttgttaaagacagtctttttcatttcaacatcaaaggattcagccgctatatatgggactttgaatcttctgccacagaaaataccaaaggacgctatctgggctatggtcaaatagaatattttgactttaaaaacagacataaatctttcaatccgcaagaaacagacttcgactggaattatattccgggagctactaccaaagtattacctgataaagtattgcaagataaaggcggatcaagttctggacatcgtaatttctcagatgagacattcttaacgggggtacatgcttccgacaaaaatgcgatgttctctttcagaatgcacgatatcacttacgatcagtcattccgtgccaacaaatcagtctttgtatttgaggatttcctgctctgcctgggttcggacatccaaactaaagataaaagataccctacagtcactactttgtttcagtcgttcagcagaaacaccagtgaagaaagaatgccggaaggatatattctgacagacccttcactcatgtacgcagtaaaaggaggagcggtacgaacttccagtgaaggctctcacacacgagcttatatagaacacgggaccgcaccggaggcggcaaaatatcactattatatacttaaaaacaagaaaaaagtattggcccgtcaactattatctaacgagagtccgataaaagtaatagcacaggataacgatgcgcacattgttacctataaaacgaaagaaattacatgcggcgctcttttcaatgcacagaagaagtatgaaggtcaactggtatcccaagtaaatattccgctttcttatatactggaaaagcagaaggacaattcatttaaactctctgtttgtgaaccggatatgagaagaatatcccgtgcacatatgggactactgacggaagaagatgtaatacaacaagagaagccttatgatacgcaactgaccatcaatgggctatataatgtggaatgtccccaaaaaacaataaaagtatcattggataaagaaaaggacaaaacatatataaccatttctactatccggggagaaaactatacgcttttattacaccaagctgatcattaattatgaaaactcgattaatagcattatttattattactctttgcataacaggtactaacgcccagggcaatctgacactttggtataagtctcctgcaaaagcatgggaagaagcattgcctgtaggtaacggacgtatgggagccatgatttttggaaatccacagaaagagagaatacaattcaatgagaacactctttatagcggagagccggaaactcctaaaaacataaatatagtacctgatctcgctcatatacgccagttactcaacgaaggaaaaaacgcagaagcaggaactatcatgcaagagaaatggattggcagactcaatgaagcctatcaacctttcggagatttatatatcgactttgcttccaaagcaaccgtgacagactatatccattcgctggatatggaaaacgcagttgttacaacttcttataaacaaaatggcgtaaagataagcagagaagtctttgcatcttatccggcacaagctattgttatacatttaaaggcttcaaagccggttttaagttttaccgcttatctgaattctccacatcctgtaacgaatgagtccgattcacaagttgtttacctgaaagggcaggcacctgcacacgctcaacgaagagacacagaacacatgaagcgtttcaatactcaacatttacatccggaatattttaatgccgcaggacatatcatacagaaaaagcacgtgatttatggaaacgaaatggatggaaagggaacgtttttcgaagcatgtctccttccaagtcataaaggtggaacactatccatttcaaaccatcaggtcactgcccgaaattgcagtgaagtgaccctcatgctatatgctgctaccagttataacgggccgcgtaaaagtccgagcaaagaaggtaagaatccgcatcaagaaattatgagttttcggaaaatcagtgaaggagaaaactaccaagaattaaaaaagaaacatatcattgactatcaatccttatttaaccgggtatcttttattcttccggcgaaaaaactacaaaaagaattgccgacagacgaacggttaaagaaattcaaggaagaagaagatcaggcattaatcgcacagttatttcagttcggacgttatttaatgatagccggttcccgaggcgaaggacaacccttgaatctgcaaggcttatggaatgatcaggtattacctccatggaattcaggatacaccttaaatataaacctggaaatgaactattggccagcaggagtcaccaacttatcagaatgtcaccagcctttattcaaactcattgaagaaatagcagataaaggtaaagaactggctcgtgatatgtatggattaaatggttgggctattcatcataacatatctatatggcgggaagcatacccatcagacggatttgtttattggtttttctggaatatgtccggcccatggttatgtaatcatatatgggaacactacttatttacgaaagacgtggactttctaaagaaatactatccgatactaaaaggatcagcaacattctgctccgaatggctaatcgaaaacagtaaaggagaactggtaactccagtcagtacttctcctgagaatgcatatcttatgcctgacgacactccggcatctgtctgcgaaggtagtacgatggacattgccattatccgatccttgttttccaatacaattgaagtttcaaagatacttcagactgatagggattttcgttcggagttaatcaaaaagagaagtaaattgaaaggataccaaatcggtagtaaaggacagctattggaatgggacaaagaatataaagaaagcgaaccgcaacatcgccatgtatctcatcttttcggggtgtatccgggatgtgacattacagacaacactccggaactattcaaggcagcacggaaatctttgaatgaccgtggaaataaaacaacaggatggagcatggcatggaaaatctctctttgggcacgtttgtacgattcatcaaatgcttatgaagcgttgagtaatttggtcaattatatcgatccccatgtcaaagctgataatcgcgggggattatatcgaaatttactgaatgcacttcctttccagatcgatggcaatttcggagctactgccggcattgcggaaatgttattgcagagtcataatggaaatattcatttgctcccggccctcccccctacctggaaagaaggaagcataaaaggactaaaagcacgaggcggatttactatagacatggagtggaaagaaggaaaaatgacagtcgcaaacattaccagtccatacgaacagaccatcgaaattgtttataataaccaaataaaaaagactcatttcaatgcaggagaaagaaaaaagatttcattttaaacgaacgggaatagggctctagcccccttgtaaagggcatgcttgacaaaattaatagttttttcaacaaaactaatagtcgaaattctgtttcaatgtccttttcaacattcgtatcatttaaaattaaacagatcatctacttttgcatcagttacaaaacttctaaaaacaatcacttaaaatgaataacatgaaaaagaaacttgttctctttgcttcggttgccattgcacttgcatcgtgccagacaactccaaaggaagactacagttggattaagaaagggctggatgtagcttctgcccagttacaacttacagcagaagaaattgacggaaccggtaagcttccacgttcaatccgcactggatatgacatggatttcctctgccgccaattagaaagagatccttccacttttcaggattcacttcgtccgcaacctactgccgaacaaatgggcaaacgtcgtttatgtgtagtatacgactggacaagcggtttcttccccggatcactgtggtacgcatacgaactgaccggaaatgatacactgaaagcggatgccattcaatatacaaacctgctgaatccggtacgctattataaaggtacacatgatttgggatttatgatcaactgcagctacggaaacgctgagcgtctggctcctaacgataccatcaaagctgtcatgaaagaaactgccgataacctgagcggacgtttcaacgattcaatcggagccatccgttcatgggactttggcagctggaacttcccggtaatcatcgataacatgatgaatctggaccttctgttcactgtaagcaaatggacaggcgacaacaaatacaaggatgtcgctatcaagcatgccatcactacgatgaaaaatcatttccgtcctgactatacttgctggcatgtagtaagctataacaacgacggcacagtagaacgcaaacagactcaccagggtaaaaacgacgattcttcatggtcgcgcggacaggcttgggctgtatacggatacacttcctgctaccgcgaaacaaatgacactaccttcctgaactttgccgtaaacatagccgacatgatcatggagcgcgtgaaaacagacgatgcaattccttactgggactacgatgctcctgtcaccgaagagactccacgcgatgcttcggctgctgctgtaacagccgcaggattcattgaacttagcacaatggtacccaacggaaagaaatatctggattatgcagaaaaaattctgaaaagcctttcaagcgacgcataccttgccaaagtcggcgaaaaccagggattcatcttaatgcactctgtcggatcattgcctaacggttctgaaatcgatactccgctgaattatgctgactactactatttggaagcattgaagagattcatggacttgaagaagttgagattggagaatggagaggtgaaagttattgagtaacatagctgagaaaattcaaatctaaattgtaatttgcagaataataaatgatatcatgaataaaactctgaaatatatcgtcctgctgacatttgcttgtttcgtaggcaaaggttatgcccaagagttgaaaagcgaggtattctcgcttctcaacctggactaccccggattggagaaagtaaaagccttacatcaggaaggcaaagatgaggatgccgcaaaagcactgctcgactactaccgtgcacgtacgaatgtgaagactccggatattaatctgaaaaagatcactatcggcaaagaagaacagcaatgggcggacgacggattgaaacatacattctttgttcacaaaggttaccagccttcttacaactacggagaagatatcaactggcaatactggccggtgaaagacaatgaactccgctggcagttgcaccgtcataaatggtttactccgatgggtaaagcataccgtgtatcgggtgacgagaaatatgccaaagaatgggcataccaatacatcgactggatcaaaaagaatccgttggtgaagatggacaagaaagaatatgaactggtaagtgacggtaagattaaaggcgaagtggaaaatgtacgtttcgcatggcgtccgctggaagtaagtaatcgtctgcaggatcagactacacagttccagttgttcctcccctctccttctttcactccggatttcctgactgaatttctggtgaactatcataaacatgccgtacatattctggctaattactctgatcagggtaatcacttgttgttcgaagctcagcgtatgatttatgcaggtgcattcttcccggaatttaaagaagctccggcctggagaaaaagtggtattgacattctgaaccgtgaaataaacgtacaggtttacaacgatggcggtcagtttgaacttgacccgcattaccaccttgctgctatcaatatcttctgcaaggcactgggtattgcagatgttaacggattccgtaatgaatttccacaggaatatctggataccatcgaaaagatgatcatgttctatgctaatatttctttcccggattacacaaatccatgtttcagtgatgctaaaatcacggaaaaaaaagaaatgctgaagaactatcgtgaatggagcaaactgttcccaaaaaacgaaactatcaagtatttggcaacagacggcaaagagggtgcattacctgattatatgtcgaaaggtttcctgaagtcaggtttctttgtattccgcaattcctggggaatggatgctacacaaatggtagtaaaagccggtccgaaaggtttctggcattgtcagccggataacggtactttcgaaatgtggtttaacggcaagaacctgttccccgactccggttcgtatgtatatgcaggtgaaggcaaagtgatggaacaacgcaactggcaccgtcagacttccgtacacaacaccgtgactctggacaataaaaatctggaaacaaccgaatctgttactaaactgtggcagccggaaggcaatatccagacattggttacagaaaacccaagctacaagaacttcaagcaccgccgttcggtcttcttcgtagacaatacctactttgtcattgtagatgaagtatcaggcagcgccaaaggttctgtcaacctgcactatcagatgccgaaaggtgagatagccaacagccgcgaagacatgacattcctgactcaattcgaggatggaagcaacatgaaacttcaatgcttcggccctgaaggcatgagcatgaaaaaagagccgggatggtgttctactgcatatcgcaagcgctacaaacgtatgaatgtttcattcaacgtaaagaaagacaatgagaatgcggtacgttacatcacagttatttacccagtcaagaagagcgcagatgcccctaaatttgacgctaagttcaagaacaaaacgttcgatgaaaacggactggaaatagaagtgaaagtaaacggcaagaaacagtcattaaaatataaattataatccagtgaccagcgaggcactgagaccagatttccatgcggatatatgcccgctacggaaaaggcctcggctcctcactggtcattttttatcatcagatgttatttctatcatgaaaagcaatccctctaccttactgcttccattggctgcactaagcctcgcttcctgtgccaaccagaaaaaagaagaaaccaaacgtccgaacatcatcttcatgatgaccgacgaccataccacccaagctatgtcctgctatggtggcaacctcatccagactcccaatatggatcgtatagccaatgagggtatccgttttgacaattgttatgcagtcaatgccctttccggtccttcacgtgcctgcatcctcaccggaaaattcagccatgagaacggctttaccgataatgcaagcaccttcaacggtgatcagcagacattcccgaaactacttcaacaagccggttatcagactgccatgatcggtaaatggcatcttatcagcgaaccgcagggatttgaccactggagcatactcagcggccagcatgagcagggcgactactacgaccctgacttctgggaagacggaaagcacatcgtagaaaaaggatatgcaacggatattatcaccgacaaggcaatcgatttcctcgaaaaccgcgacaaaaacaaacctttctgcatgatgtatcatcagaaagctccccaccgtaactggatgcccgccccccgccatctgggtatattcaacaatactattttccccgaacccgcaaacctgttcgatgactacgaaggacgcgggaaagcggcacgggaacaagatatgtcgatcgagcatacgctgacgaatgactgggacttaaaactgctcactcgcgaagaaatgctgaaagatacgacaaaccgcctgtatagcgtttataagcgcatgcctgtagaagtacaggacaaatgggattccgcctatgcacagcgcattgccgaataccgcaaaggcgacctgaaaggcaaggcattaatcagctggaaataccagcaatatatgcgcgattatctggctaccgttctggctgtagacgagaatatcggtcgtctgctgaattatctcgaaaagatcggcgaactggacaataccattattgtctatacttccgaccaaggattctttctgggtgaacacggctggtttgacaaacgattcatgtacgaagaatgtcagcgtatgccgcttatcatccgttatccgaaggccattaaagccggaagcaccagcaacgccattagcatgaacgtagacttcgcccccactttccttgactttgccggtgtagaagtgccatctgatattcagggagcatcactgaaaccagtattggaaaacgaaggcaagactcctgccgactggcgtaaagcagcctactatcattattatgaatatccggcagaacactccgtaaaacgtcattacggcattcgcacgcaggacttcaaactgattcatttctacaacgacattgacgaatgggaaatgtatgacatgaaagccgatccgagagaaatgaacaatatcttcggaaaagcagaatatgctaagaaacaaaaagagttgatgcaactacttgaagaaactcagaaacaatataaagacaatgatcccgatgaaaaagagacagtgcttttcaaaggagacagaagactgatggaaaatcgataaataacccaaaacaatcatatcatggacagaagaaattttataaagaatactggctggtcttttttaggactggcagcatccggcagcctgctcggctcttgtgcggcaggaagtaaagaagccaaaaagaaaatgccatcggcaagtgacctcaaaatgtactggggagacctgcacaaccattgtaacatcacatacggacacggcgatatgcgcgatgcttttgaagcagcgaaaggacagttggattttgtaagtgtaacaccccacgccatgtggccggatatccccggagcagacgatccacgcctgaaatgggtaatcgactaccataccggtgctttcaaacgtttgcgcgaaggcggatatgagaagtacgtagccatgacaaacgaatataataaagaaggagaattcctcactttcgttggatatgaagcacacagcatggaacatggcgaccatgttgccttgaactacgatctcgatgcaccgcttgtagaatgcacttccatcgaagactggaaacaaaaggccaaaggacacaaagtattcatcactccgcaccatatgggctatcagggtggttatcgcggctataactggaaatgctttaccgaaggagaccagaccccgttcgtagaaatgtattctcgtcacggtctggctgaaagcgatcagggcgactatccatacttgcacgatatgggcccccgccaatgggaaggaaccattcaatatggtctggaactgggtaataaattcggtattatggcttctaccgaccaacattcgggttatccgggcagttatggtgacggccgtatcggtgtactggctccgtcattaacccgcgacgctatatgggaagcacttcggacccgccacgtatgcgccgcaaccggcgataagattttgattgacttccgcctcaacgatgctttcatgggtgacgtagtgcgtggcaacagccgccgcatttatctgaatgttaccggagaaagttgcatcgactatgtggatatcgtcaagaacggtcagattctggcccgcatgaatggtccgttgactccggttgcccccgaaggtgatactgtccgctgcaaagtgaaagtagatttcggatggaaccgtgaagagcagtatgtacactggcaaggtaaattgtctgtagacaaaggacgcattctgagcgtcactccatgtttccgcggtgcagccttcacttctccgcaagaaggggaaacagaattccatactcacgtaaaccgcattgtatccgcagacgaaaaagaaaccgaactggatatgtacagcagcaagaatccgaatacgactaccgctgccatgcaagctgtcatcctcgaagtagagatgccgaaagacggaaaagtgattgctgatttcaacggcaagaagtttgaacacacattgggcgaattgctcgaaggctcacgttcgcacttcatgatcggctggctgagcgaagcgattctcttcaatcgtgctatgcccgaaagctgtttcactgtggaacactatatggaagataaagagcctcagcgtgatacagattactactacgtgcgtgttcgccagcgtgacgggcaatgggcatggagttcacctatctgggcagaaagagtataaactggtatatgaaagaaaacagttgctttgcttgtgccaagccgttggcacagttgtgtcaagctgttggcactgctatgccaagcctttggcacaagcgtgccaatacggtggcacaagcatggcacagtataaacgaatttaaaacatacctagttatatggaaaaagaatacgctataggaattgatcttggcgggacttctgtgaaatacgctcttattgataataatggcgtatttcactttcaagggaagctaccgtcgaatgccgacgtatcagccgaagctgtcatcgggcaattagtcaaggcagtcaatgaagtgaaaacctttgccgaagcaaaggaatatacgatagccggtatcgggatagggacaccgggaattgtcgattgtacgaatcgtatcgtattgggaggtgcggagaatattcaaggctgggaaaatctgaaactggcagaccggatggaaaaagagaccggacttcctacccaactgggaaatgacgctaatctgatgggactcggcgaaacgatgtacggagccggaaacggagccactcatgtggtctttctgactgtaggaaccggtatcggtggcgcagtcataattgacggcaaactgtttaacggatacgccaatagaggtactgaattgggacatgtccccttgatagctaatggtgaaccttgcgcctgcggttcaataggatgccttgaacattatgcttccactgccgcactggtccgtcgtttcagcaaacggatagccgaagccggcatctcttatccgaatgaagaaataaacggagaattgatcgtccgtctctataaacaaggagataagattgcggctgagtcgctgaacgaacattgtgatttcctcggtcacggcattgccggatttattaatatcttcagccctcaaagagtcgttatcggcggaggactgtccgaagccggagacttttatattcagaaagtaagtgagaaagcccttcgctatgccatccccgactgtgccgtgaacacggaaatcatggcagcctctttaggcaacaaagccggaagtatcggtgccgcctccctctttttaaatagaaaaccgaattaaatgaagagcagaaaaccttctcaacttatttaagattatgaagaaaaatctaggaatgctggcgctaattatggcgttctggttcactatctcgtttattaccaatattctgggaccgcttattccggacattatccacaatttcaatctgagcgatcttgcgatggcggggtttatcccgacttccttctttctggcttacgccattatgtccatccctgccggactactgatcgaccgtttcggtgaaaagcctgtcttgttctgtggattcctgatgccgtttatcggaaccatcctgttcgcctgtatgcatacttatccgatgttgctagcttcatctttcatcatcggtctgggaatggcaatgctgcaaaccgtgctgaatccgctccaacgtactgtaggaggagaagaaaactatgctttcatcgctgaactggcacaatttatgttcggtatcgcctccttcctaagcccgctggcatatacttatctgattcgggaacttgatcctgccacttatacagcaggaaaaagccttatccttgacttgctggcggatatgacgccacaagatatgccttgggtatctctctactgggtatttaccttattgttgctggtgatgctgattgccgtcggtgtttcgcatttcccgaagattgaactgaaagaagatgagaaaagcggatcgaaagattcctacctcgccctgttcaagcagaaatatgtatggttgttctttctgggaatcttctgctatgtcagtacggaacaaggaacctctatcttcatgagtaccttcctcgaacaatatcacggtgtaaacccgcaggcggaaggtgcgcaggcagtcagctacttctggggactgatgacggcaggctgtctggtcggaatgattcttctgaaactgattgacagcaaacgcctgctacaggtttcgggggtattgacgatagtgctgttactagccgctttattcggaagcaaggatgtttcgctaatcgcctttcctgctatcggattcagtatttccatgatgtactctatcgtcttctcattggcgctgaactcggcttcacagcatcacggctcatttgccggaattttatgttcggctatcgtgggtggagcaggcgggccgatgattgtgagtacattggcagatgctacgtccttgcgtacaggtatgctgtctatcctgctctttgtgggatatatcaccttcatcggtttctgggcacgtccgctgatcaacaacaagacaatcagtctgaaagaactcttaaaaaaataagatgatgaaacaacgatattatattttcctgttatttgtagctatgctttcctatagtggatatgcgcagaaaagcatcctgcgtctgagtcagcagacgctgatgcatgaagtccgcgaaacaccttctccactagacggtcagcacatagcagtcaatccgccgcgtttcatgtggccggataagttcccccacctcggacctgtgcttgacggagtggaagaagaagatcacaaaccggaagtgacataccgcatccgtatcgcacgtgatcctgagtttaaatcggaagtaatgaccgccgaaagaaactgggctttcttcaatcctttcaaactctttgaaaaagggaaatggtattggcagcacgcctaccttgataaggacggcaaagaagaatggtcgcccgtctatcatttctatgtggacgagcagacacgtacgttcaatcctccctccttgcaagaagtgctggcgaagttctctcaaagccatccccgtatcctgctcgatgccaaagactgggatcagatcatcgagcggaacaagaataatccggaagcgcagctctatattcagaaagcaaggaaatgcctcaatcatccattgaaacatctggaggaggaaatcgataccacccaagtagtcaaattgacaaacatcgtacaatatcgctcggcattgattcgggaaagccgcaagatagtagaccgcgaagaagcgaacatagaagctatggtacgcgcttatctgctgacgaaagacgaagtgtactacaaagaaggtatcaaacgtctttccgaaattctttcgtggaaagacagtaagtacttcgcaggagatttcaaccgctccacgattctgtccatgagtacttccgcttatgatgcatggtacaatctgttaacgcctgccgaaaaacagttgcttctcgaaacgatcagcgaaaacgcccataagttttatcatgaatatgtgaatcatctggaaaaccgtattgccgacaatcatgtatggcagatgactttccgtattctgaatatggcagcttttgctacatacggtgaattgccgatggcttccacttgggtagattattgctataacgaatgggtatcccgtctgccgggactcaacaccgacggaggatggcacaacggtgactcttatttccatgtcaaccttcgtacattgatcgaagttcccgctttctattcacgtatcagcggtttcgatttctttgccgatccctggtataacaacaatgtgctctatgtaatctatcatcagcctccgttctccaaatctgcgggacacggtaactcccatgaaacgaaaatgaaaccgaacgggacacgggtcggctatgcggatgctttagcacgtgaatgcaataatccgtgggcagccgcctacgcacgtaccattctagagaaagaaccggatatcatgaaaaagtcttttcttggaaaagcaggtgatctgacctggtatcgctgcattactgacaaggcactcccgaaagaagaacactcattggcagagttgccgatgacgaaagtatttaatgaaacgggaattgctacgatgcatacttcgttgggggatatagaaaagaacgcaatgttgtcattccgttccagtccatacggttcaacttcgcacgcattggccaatcagaatgcatttaataccttctatggcggcaaggcgatcttctatagcagcggacatcgtaccggttttaccgatgaccattgtatgtattcctatcgaaacacccgtgcacacaacagtattctggtcaatggaatgactcagactatcgggacggaaggttacggatggattccccgttggtatgaaggagaaaagatttcgtatatggtgggagacgcttccaatgcttacggaaagatcacaactcctatctggttgaaacgtggtgaactttccggcacgcagtacactcccgaaaagggatgggatgagaacaaactgaagatgttccgtcggcacatcattcaattaggcaatacgggagtgtatgtgatttatgatgaactggaaggaaaagaagcggtcacatggagctatctgctgcatacggtagaacttccgatggaaatgcaggaacttcctgatgaagtgaaagttacgggaaagaataaggatgaaggcatctctgttgctcatcttttcagttcggcaaagacggaacaggccatcgtagataccttcttctgcgctccaaccaactggaagaatgtaaccaatgcccagggaaaagctgtgaagtatcccaatcactggcatttttcgtctactaccattccatgtaaaactgcccgtttcctcaccgttatggatacacatggaaataaccgtgcggatatgaaagtggttcgccaaggcaatacggtacaagtaggcgactggattattacctgcaatctgacggagaaagggaaagcggcaatcagcgtcacccatcaagcggaaaaggtttctttgaaatacgatgccggcaagaaggaaggtgcgactatcatcacagatcaagtacaagggaaacaggtcaataaggttctgactgactatttaccggattttgagatataatttctccattctggcacacaatatggagctattcaatggttattataaacttacgaatagctcctttcttttattgtcttttattgaaggtgacaatgcttattatgccacatttcaagcattaataatgtccatgacaggtattaatatctgacttttcaggtattaacagttgacatctcagatattaacatctgacaactcaaccattaatacctgagatgtgggatataaaaagacagtagatcactgtacctttatcataatgagcattgagtttactactaaaaaattgtatctttgcctatgttggtactctacgcaaacattgaaacctgcataaatgttatatcaacagataaaatttaaatagaataaaagatgaaatacattggagcacatgtaagcgcatccggcggcgtagaattcgcccctgtcaatgcgcatgagattggagcaaatgcctttgccctgtttactaaaaatcaacgtcaatgggtgagtaaaccattgacagaagaaaacatccgtcttttcaaagaaaattgcactaagtacaatttccaaacagactatattttaccgcatgacagttaccttattaatttgggacaccccgaagaagaaggattggagaaaagtcgagctgcctttttagatgagatgcaacgctgcgaacaattaggactgaaacttctcaatttccatcccggcagccatctgaataaaatctccgtagaggattgtctcgcactcattgcagaaagtatcaacctgactttggagaagactaaaggagtaacggccgttattgaaaatactgcgggacaaggcagtaatttaggaagtgaattctggcaattaagatatatcatcgaccgggtgaatgataaaagccgtgtaggtatttgcctggatacttgccatacatatacagcgggatatgacatagtgaatgattacgataaagtctttgacgaatttgaaaaagaagtaggtttcgagtatctgcgtggtatgcacctgaatgattctaaaaaagaattaggcagtcatgttgaccgtcacgataacataggccagggactgaccgggagtgcattctttgaaagattaatgaaagattcaagattcgataatatgccacttattcttgaaacacccgatgaaagcaagtgggcagaagaaattgcatggttgagaagcgttgaataaacgcttcacttcttttttaataaatattcgccatactgactaacggctcatagagtttctcgatatcctgcgagtccatttctatctgcacctgatcccccggcatcagtttctgccctttgggaggccagtttttccggtcacgatgaacattaataataatgcaacgttccggcaggcgaagttcatccacgattttaccatccaggtaagaaccgctcatgacctctaccgataaagtgtagcgggcctcttctttaaacgcaggagaattaatcatatcatcatataaaatcacattgaaaggttttatctgaagcatttccgtgaaatagtaagtcagtcctcccactacaatagaaggataaaagacttccagatgtcccgtaatctcagtaatcagcacaatagcggtgagaggtgtacgtatgaccgcaaccagaaaagcagacatacagatcaacatgatataactgatattttcataagcaatcactccttgctgaaccagaatcaatgcaactatttgccctaaaagccctcctgtcactaatgtaggaatgaaacttcctcccggcagtcctgacgaaaaagaaaaggtactgaatacaaaatgcaacaacatcataccgacaatccaaagaatatgggtatcgggatgcatggcctgtgccaacagaaactgttccccacctcctgtcagattgacttctgccatagagatgagataagcaataaagagcagatatagcatttttacgtattccggatgcttgatggccggatagatatgtttgacctgaagcgtagtgacagaaaagaactttccgaaaacagaaaccacagccgccaaaagaagaaacaactttacctgtgaccagaaagtcattcccggtacaatcgcatcaatctgaaaatacggattgataggaaaaagccaactggcgactcctccggcaacgactcctgccagcaaggtagtaatcgccgtctttggcgcatcaaaccgttcaatagattctataaccagcaatgaggaagccaacggagcagcaaaagcagccgccaacccggcaccggcacccgccgccaacaattgtttccgctcgccggcaagcactctcccccatttagaaaccagacatcctacatacgaaccgatctgcaccgaaggtccttcacgtcccaaagacaaaccggtgcttagcgcaagtattcctcccacaaacttggcaatcacctcaatgaaaggatgtttatacgcaactcttccattgataactccacgtgtttgtggaatacctcctcctgtgatcaacggcatctttttcaccagccaggagacaaatataagaatcccccacattaacagaaaaagaggaaggtaccaataccatttaggatgagaatcaaagaagtcatggcgaagattgaagaagaactgaagcaggtaatgataaggcacagcaataagccccgtcagtaacccgacaaagatactgacaaagtaaagccgcgcatcaatcaatttgagtttgaagatacgccaacgtcctctgtcctttaattttttaatcagtcgaaactccattcagcaaagttttcattgttttcgcatggatacaacaattaataccccgcagaggtttcagactgataaatatttaatcagctttatccttccagcagattcagacgcagaataccatgtatcatgagtcagcatcaactacacgtccggcaaagctctctttgccggactgtgcataggctgccaaaacttatcagtaacaagacacaatgaataatcaaacgatactgaaaagaatagatatatctgcctatgcccaatttgtgttgactttagtaaaataaaacactataataaataatacctaatccattatctacttttgagtttgatgaggggtatgctgtctttgtctctggcggtcttgtccgggtttatgaccttgtcccggtttctgtccttttctacggtcaaactcttttctgaatttattcatattgctcttttcctgctgataaatcttcatgatctgcttttgagacagaatcttgctgaactcattataatacttctcacggatgtccagcatcttacgactctgcgcaaactgatctttcaacattttagcgatttccgcatctgtcataaccggttttggagtttctttggcagtattggcttccgtaccttgagctgcatcttttctcgctctgggtttgaagttcatcatacgacactcacgaagttctttcagatacttctcgtatatcggagtaaacttggctgccgttgcatcatccagcatgagcgctctcaccatctgattggtctgcatctgcatcatctgctccggtgtaggatgctgttttctttctttgttttctttattctgtgcagaaagggtcatctggcttcccaaaaataaagccatcaacactacataaataaacttagtcttcataatcttcacgttttaataattaattgagttattcagtttaaaaatatatcgttttcagagaagctgacgagctcttccaactcctcatctgacaattccttaatccatttatctaccggatctgttgttacattatttttatcgacagccaatatatttgaagcagatggtgtgtcggtattcatatagcggagagacggcgtaaacaaaatcccggccaatactgctgctacagcaatcacagtaggaataatccttttcagccgacgcttcttgcgttgctcgtcaaccgtacgttccaatatcttacgctgtgtctcctcaaaaaagttatcgggagtgcgataaggtgtccgcttaccaatattgtcaaaatcaaaatccttatccatgatgttacctgtttaatatatattcctttatcttatctttcgcatagtgataattcactttcagtgtctcaaccttactatccagaacacgggcgatatcttcatattccagttcatcgtaatagcgcaagttgaaaacgatccgctgcttttccggcaaagtcaatatagcttcctgaaactttacagccagttcatcttcgtagtcgacatagtcagaagctttcagtttactcatcagttcttcctgaacatcttccgctgatattacttcttctttacgactattcaataaccgaagacactcattcgttgcaattctgtagatccatgtactcagcgaactttcattccggaactgatccaaatggcggaatacacgaatgaagacttcttgcagcacatcttccgcatcttcgtgagacactaccattctccggatataattatatatcggttcctgaaaactgtccaccagcaacctgaatccccgctcgcgatctgaggaacaagcttttcggattttatcttcgtttatcatctattatttctgagctttggttattagaacgccgaaaaggaacgaagttaaatgcacaagagccgattttacatttattaatagaaaagaggaaatatgacattggcatacaaggaataaaaaaacgcctccataatctttttcaagaccatggaggcgctgttaactctttatatacaagccgaagttgactgaaaatcaccagaacttattatgttccgcactatattcaaaacctgcagctttcaactgactgacaatatcttctctgcttacatccatatcttcgcaaagctcatctagcgaagaataacagtcacgcaacttcatattgatgacactgaacagcaccatcggatctttaggcaattccatattctacaatcttttaaaccgggcgcaaagttacagcaatcccggcgaatggcaaaacaaatcaagggccgatttcttctattttcaaagagattctctcaatcagcttaccaagttcctcttccagaggtatcacattaaaatccctccagaagtcttcatcatatttgaaattcagatcagagaagatagtacgcgtcggtaatctttctgcccgcgggaatgcagtcacttgttccgtatccactttgcaagtgatcatttcaaaccagatctgcatctgcggactagcagacagcaaccgtcgccgtttcaccttgaaagaaaggtctccacggatatgatgaatataatagataccttgccatggtttgtaggaaatagtataaaccaccttttgcggtattatctgaatgccatgcgtgcgcctttctacaaacatttccgacgctttctttacacgctggggatctacctcaaaacgagcttgtaacaaggcattcgtctcggcatcaatatacaaatctccgcaatagagaggctcgataatctccttcttttgtgcaaagtgtatgacattcacacaccggtcgtctatgaatgtcactccctgcgaagtatacagataaccgttatcacctgcgtcaggtatcaggaatgaaggcatatccttcattatatccatctgaaaacatgcctgaatgccggacttcacctttacaagcagactgtctttggcttcgacattactcagccgactcatcttcaacagcttcgcctgatcggaaacgggagaatgcgaagcgatcttataaactttgaaaactgcttcagtaagattctgaaccttatttttcaataaaactccttcacggtaaaatgtggtcaggtaggcaggagaatgagaatagttctgctctctttgccttcccatttctttcagcagcttataaggatcgacccattgaaccactacttcctgtaaaggaacaacctttggttccaagctcagaatatgatggcgacctgccaaaacagaaacttccaaagtttgtgaaacatatcctatatgagaaaaaacaaccgaatcgttttgcaaagaatccggtaaggaaagtctgaactctccttcctgattagtaacaatccccacagatgtcctccggactccaacggatgcagaagcaacaggcattccggtttccttatccagtaaagttccggtaagcatcagatttacagggtgaacggatgaaggtttcgcctgttgctgtttggtcggtgaagaagaagttatcagaatatgagtccctattactttaaattccaggctggtatctcctgttatctcataaatagcctgacgaatggttcgctctcctttccgtatcttcaccgttacatcattatctactactttactgtcatagataaacagataacctgactgctgagaaatattgcctaacagtgaatagaccgttcctttcatcttcggcaggctgatcatacgctccagcacatcttctccgtcagctctcaacgtatccggtacgataaagaacaaacacagaatcaccatatagcgataaaccagcctcatctcacttttttttatttattctgtcagcatgaatgtatccccctgccgtgtgcacttcaaattaagcgcataggctatcaatgtagccacagtctctggagattcattggaaaattcaactgtcagctttcttttttcaagcgcaggagaagctacacgtatctgcgaactgcctgcattcatattcattactttcagaatatgccccaaagattcatctttaaaacagacatgcttcagatagcgattcaactctccggcattttcagtcgaactgagcaaaagttgctgtgattgcaataccactgtctcaccagctttgacataacattctttatttccctttttaagggttactctgacggttccccgttgcaccgagagacggaacggagtatctttgacgctctttacactaaaagcagtacccaatacttcaatctttacttcctttgtatcaatccaaaaaggttgcttctgtttctttgccacatcaaaaaaggcatctccctgcaaactgacttcccgtttgtcggaaacaaaatgttccggatatcggatagaagtctcctttgccaaaaacacgacagaaccatcttccagagtcgtgaccaatgtaggaacatcttgattctcctgtgttataaagtcaggtaattcctctttttgaccgaatccccaatacaaagtactaaaaaccaaaccgaccaccatcgccgctacagtgccatagcgtacccacatcgggattttaggcatccgatggtcttctacaagcagatgatctttatccaatcggtcgtacaaccgattccaagcctgctccgtctttattttatgaatatccgttttcatcatttcatttgaatataattttctatttcttttcgcaaagttcgtaaagtcttcgtcatttccgcttccaccgttttgacggagagagaaagctggactgcaatttccgcatatttctttccctccgtccggtgcattttaaatatctgcattctgcgttccggcaatttctcaagggtattatttatcagcttctgaagttcttcatattccatctgctgatgaggatctgtcacctgttccgaagaagatgcagtcagcacagactctctataccgctctttgacctcttcatgctcacagtattgaattgactgattacgtgtcgccctgtagaggtagttttttacagactggaaaatctgtaactgttccctatccttccaaagcacataaaacagttcctcaacaatttcctcagccacctccatccgtccggtaatgcttgccgcataccaacacaagggagaatagtaacagcgaaatagttcctcaaacgcttttatgtcacctgcctttatttttgtcagtatgagcagttcattcagcatacttctatcattttacgattgttcccaaatataagaaaacaattctgattttaattagattgctttttcaatttatcgacagcatgttccagagactccgtaggtgctatgatattataatttccccagaagtcttcactccagtaatttccgactttatcatagaaaatctgattggaggtaaatactttattccgcggaattatctcggacggactctccctccgatctgtcaccaccatttctgaggttactgcatagctcgtagagaaaagcctccgtttccagtcgcatttaaaacgaatatcattgcggatataattcagataagtccttccatctatcgttttataggttatcagaaaagataactcttgcggtttgaatctcagtccaaatggtttctgatgaagaatagcagcaattgctttcgatttattctgcatatccagattcatctcgatacgtgtaaacgacagcttatcacaatctacatacaatttcccatgaaacagcgcatatggtaaaagaactctcggacggaaattaataacatattgtatccggttatcgatcaatgccgattcagccatccagaactcatagttgttcaattcttctggttccagcagcgcctctttattctttacgatatccaaaactacagatatattaggaccacccataacctttactgccaatgtatcactaactttctgacttagcagacggcgtcctttcagaacctgtagtttatcataatccgtagtgcgattggtgtatgctgttttcgacacatcaagtacagcttccgatacactgatataacggcgccctttctgcacagtctcccgatagaagctggtaagcatattccggttggcactataatttaccggaatcttctcaatcgccttttctataattgtacgcggattattggcataaacgaccacttcattcaactggttagtatgaggtatcatccagaccgtcaatttagaagaattattcttatctaaagatacatgactattgatatagcctatgtgagagatttccaactctcgcggcacttcttctttcctgactttcagagcaaactctccctctgcatttgtcaccgtaccgatattacttccttgcacagatacattcacgttttcaagtgttctcttattttgcttatccttcaccattccgacaatcgtgaaataatctcctgcatcctgcgcccatatatcagcactccctatccatagaaaagctaataaccatccaaccaaaagtataactgactttttcatcttaataaagttttaaagtaaataattcctgcttctataaataagatcgttcaatctgcaaataccctattgtctgaaataaaaaaaatcagtatcttgcccgacagacaaaaattatattctcaacaaatgattaattatgatacgcaaattagataaagcagaatttcagcaggcgacaactttagcattagaagtatacttgcaatgtggtcaggatgatttcgaagacgaaggtcttgagagtttcaaaagttttatattcaacgataaattgatgaatgaactctgcatttatggagctttcgaagaaaataaactaataggtattatgggaaccaagaatgagggcaaacacatttctttgtttttcatcaaaaaggaattccatagaaaagggataggcaagcaactgtttgactattcccaatgtgattgtccggcaaatgaaataactgtaaactcatctacatacgctatcaggttttacgaatctctgggatttgaaaaaacaaacgacaggcaacaaacaaacggaatcagttatactccgatgaaactcatatcaaacaaataaagaagaagatattaccattagattccagttccccggagcccaaatctaattgttaattatactttcgaatatgtatttcttataaaaatagtttctacatttgcgactgttatggcgaaatacattttctgtatattatttggtatatttctgatatggggatgcaatttagtgcccgataaagaattacaggagttccggacagaggccggtactaccactatacaatcccataataagtcacagagttaccgatccaaagctgtagtcaaacaatccggtaaagaaaacaactccttccaagaagggaaatatgatggaaaatatgattgcaacattgccgatggtattttaggaaactcacttttatcccgtaccacttctctttccaaaattctaagattcaacgtttcttccgttacaattcggatactaagttccttaaaatatcaatttccgaaagaaaaatggactggtctcccctactacacaaatctcaccaaattctcatatagatattacgtctatacactaggacgaatacttatttaaatatctcttttccttctatgggatgagatgagtgtatcttcatgcccattttatctctttatattcaaggcaagaaagcaagaagagtcttttccattgccgggaatatgcatacgatttcacttttacatattaataacttgatatataatggaatttatattagactttattctccacattgatcaatacatgattaatatagtgcaggattaccatacttgggcatatgctatcctattcatcattatattttgcgaaaccgggcttgtagtcactccctttcttcctggtgattctttacttttcgttgcaggagccatttccgcattacccggtatgccgatcgatatccatattcttgttttaatcttatttgcagcagccgtattaggtgactcctgcaactacatgatcggacattttttcggacgcaaactttttcataatcccaactccaggatattcaaacaaagttatcttgataaaacgcatgaattttataaaaaatatggtgggaaaacgattattctcgcccgctttgtgcctatcgtccgcacttttgctccatttatagccggaatgggaaaaatgcattactattattttatgatctacaatttgataggtggagctatatgggtagttttattttgctatgcaggctacttctttggcgatctgccgttcgtacaggaaaatcttaaactcttgattatcgctattatatttatttcaatattgcctgcaataatagaaatattacgagcgaagttaggatcgaagcaataaaaaactttattcatttgtttattaataacaacggccatcaaattaaacatctcaaaaacaatttaatgtactcatatttatgaaaaattctttttttagtaaatttacgcccaaagaaccaaagttctttcctctactgaagcagttatcagatgttttatctgcctcatccgttctacttgttgaaagtatggaacatgatctgcccacagaaagagcagattactacaaacaaattaaagacatggaacgtgaaggtgacagattgactcatttaatctttgacgagttaagtacgacatttatcacccccttcgaccgtgaagatattcacgacttggcttcctgcatggatgatgttatcgacggaatcaacagtagcgccaagcgtattgtaatctataatcctcgccctatttccgaaagtggcaaagaactgagccgtctgattcacgaggaggctatcaatataggtaaagccatggatgaactggagactttccgcaaaaatccaaagccattacgcgactattgcacccaattacacgatatagaaaatcaggcagatgacgtatacgagctttttatcaccaaactctttgaagaagaaaaagactgtatcgaactgattaaaataaaagaaatcatgcatgaactggaaaagacaaccgatgcagcagaacatgtagggaaaatattaaaaaacctgatcgtaaagtattcataaaagcagagcaagacacatggaattattagtgactatcattatactagctctgatattcgattatatcaatggctttcatgacgcagcaaactcgatcgctaccatcgtatcgactaaagtactgactccttttcaagcggtattgtgggcagcattctttaacttcgttgcgttcttcatagccaaatacattatagggggctttggcatagcaaacactgtgtcaaagacagttgttgaacaatacatcacgctgcctattatcctggcgggcattattgccgctattttctggaatctgattacctggtggaagggtatcccgtcttcttcctcccatacgcttataggtggtttcgcaggagctgctatcatggcaaacggctttgaagctattcagctcaatatcattcttaagattgccgcttttatcttcctggctccatttatcggtatgattatcgctttcggatttactctacttgtgctctatatctgccgacgtacaaatccgcataccgctgaaatgtggttcaagagattacagttggtttcttccgccatgttcagtgtaggacatggtctgaatgactcgcagaaggtaatgggtattatcgccgccgcaatgatagctgcccactctatgggtctgggaatgggaataaacagtatttctgatctgccggactgggtagcgttctcctgttttactgctatctcactgggaacgatgtccggaggatggaaaatcgtaaaaacgatgggaaccagaatcactaaagttactccattggaaggtatggttgccgaaaccgcaggtgcttttactctttatatcaccgaaatgctgaaaatacctgttagtacgactcatacaattaccggagcaatcattggtgtcggagcaaccaaacgtttatccgctgttcgctggggggtgactaaaagcctcatgactgcgtgggtacttactatccctgtcagtggactcctagctgcatgtatttattgtgtagtttctctgttcctgaaataaattctgcttcaagggaaacaactcgaaatttaaacaagaaaaatagctactcttaacatccctctacagtattttgtagagggaatactataaaatgatacacatagaaccttaaatatttaacgtctccttcgagatataaagaatttcttcagaaaagaattattaaacataaatcttttattattattttttaatactatctttgctttcattgtgtaatgcgacaggcaaatttaagtaataattctatgttcactcaagacgaaagttatatcaaatggaagttatttttagaaggagatgaccaggcatacagctggatatatactcattacatccaagtgctctataattatggcttacaaatcactcctgattctgaaatagtgaaagactgcattcaggacgtattcgtaaagatatataaagccaaaaagaaacttactgtacctcaaaatcctaaagtatatttaatgattgctttaaaaaataacatctataatactttcaatcaagaacgattgcaaaaaaactatgctttcagtttataccaaacagaagagcagcttactgttaaaaacgaattcattgatcaggaagcccggcatgaagaaatgaataatattaaaagaatgatgaaaatcctgactcccagacaacgggaagttatttattaccgctttatagaagaactgagttacgatgatatttgccagataatggggctcaattaccaatcggcttataaccttttgcaacgctctctacaaaaaataagagaagcctatggagtcactggaatatggatgttaatactccatcaactgacctatttacactaaaaaataaaaatctcaaaaaaaataaagagcagttgagtagatttgtcaattgagattgtcctaagataaatcaacattgaaaatggacattaaaaacaaatatactcactactctgcagatcaactactcaatgatttctactttttggagtctgagcagcatcccagcccagaaagtatcgctttttgggaaacgatgcagcaaaaagataaagcattagcaaaagaaataaaaatagcacgttcttttctgcatgatattcgacacattcctgtttcacacttaccgcaaaacgaagtagaaacagtgtggaagaatatttccagactcaacaatatagaaaaacaacgaaaaaagaaaattctttttattaatcatagtatattagttgccgccagtttagctcttatactctgttcggcatggtattttcaatcacaactcagcattatgcaagaaaaaacggaactggaaataacagctgtaaaaaggccgaacgctactcctactgataatatccaactcgtactttcgaaaaaaaaacagatagatattgatggaaaagaaagtcaattacaatatgatcatcagggcaagattaatgtaaactcccaaaccattattcaagaaactgatgacaaggaaaagactaatatttataatcaattaatcgtacctgccggtaaacgttcatctatcactttcaccgatggtacatgtatttggttaagcgctaactcaagaatcgtttatcctgtggaatttaaacaacacaaacgagaaatatatatagagggggaagctttcctcagtgtatctcatgacccgaaccggccattcatcgtgaaaacaagccaaatggacattcaagtattaggcaccacattcaacgtcagtgcttatgaaaataaacaaacgcaaagtgttgtattagtaagtggtaaaataaaagtaaaaaccagcaaaaatgaaagtaagacactttctcccaataacttattaagttataatgaacaggaaggcatccatatccaatcggtagacgtacaaaaatatatcgcctggaaagatggtttttacctcttccaaacagaaaaactaaaagacattgctacaaaactcagcgattactatggcaaaaagatcatgatagacagtccattgaagaccattacctgcagtggtaaactagatttgaaagaagatcttgacgaagttcttcagacactaatacggactgtcccggcaagaatagaaaaatcagatggaattatccatatttatgtaaaacattaattaaaatcgaaagcctatgaataaacattatccttaaaaaaataaggccgaataatacccttaatatcatccggcctttgattaaattacttacacgttaatattaattaatctaatcattacaaatgtatgaaaaagcaccgattatttagtcaccaaaggactaaagataaacaactattactaatcatgaagtttttttcactcttccttcttatcggaataggaaactgtttggctacaaacacgtattcgcagaataaactattcaccattaaatcatcacaaaagactataacggaagtctttcatgaaattgagaaaaatagtgaatatattattttctacatggaccaactcattgatacgaaccgcaaagtgaatatcaatgtcagaaagcaacaagtaagtgctatcctagatcaactttttgccggaaccgataacacttacagtatcaacgatcggcaaattaccatttaccgcaaaggagagcagccaactcctcaacaagaaaaaaataaatttgtaatcaccggtgttgtcactgattcacaaggagagtcagtaatcggagcatctgtgagaatcaaagatacaaccaatggagtaatcaccgatatggacggacgctatacaattactgcacccggaaaaaacagtattttggtaatttcatatattggctattcaactgaagaagttaaaatcaatgatcgtcgaaacatcaatataagattgcgcgaagacacaaaagcactggatgaagttgtagtagtgggatatggacagcaaaaaaaggaaagtgtagttgtatccatgagttccgtcaaagtttcagacataacagctccaacaagaaatctgactaataatctggccggacaagtttccggtcttatagcaatacaacgatccagtgaaccgggatttgatgatgccgaattttggattcgtggtatcagtacatttgcaagcaactcggcagcttctactcccctagttttagtggacggtattccccgtaaaattacagatatcgaaccggatgaaattgaaactttttccatcctaaaggatgctgctgcaacagctatctatggtgcagaaggtgcaaatggagttatattagtcactaccaaacgcggtaaagatgaaaagccgaaaattacttttaagaccgagcattctatttcaagtccccaacgtttgccagaatttgtgggatctgccgattatctaggattatataatgaagcattgcgtaacgacggtgaacctgctttattcagtgacgaaaccatagaaaagtttcgtaacagcactgatcctgacctctatcctaatacagactggattaaagagttgctcaagaaaactacaaataatcatcgatacacactaaatgtccgtggcggttccgcacgtgcaaagtactttgtttcaggtgcatattataatgaaagtggaatttacaaaggcaaccctacagacaagtatgatacaaatatcggacttgaccgttttaatcttcgttcaaacattgatatggatgtcacctcaacaactaaaatttctgttgatttggcaggacaatacttgatagctaactatccaggctcatcttcatccagtatcttccgttccatgttaattacccctccatactgttttcctgctgtatacagtgatggcacagtagccacttatgaacaggaacgaggagttaatatgaggaatccatacaatctgttaatgaactccggatatacccgccaatggcggacaggaatccagtcgaaagtaggcgtacaacaaaatctgaaattcataaccaaaggattaagtgctaaaatgaatatcagttatgacttcgacgcaactttcaaatccatacgttcatacaatccatcacgttatcatgcaacaggcagagacgaaaacgggaatcttcaattcgcacaagtagtttccggtactccagaccttagcgacctgaaggacaacggtatcgaagcgaacaaaaaaatatatattgatgcttccatcaactataaacggacctttgctgaaaaacatgatgtaaccggaatgttgctctatatgcaaaaagaaacacaatataaaaccgagccactaccataccgtaaacaaggtgtagtaggacgtgtaagttatgcttatgacggacgttactttattgaaggtaacttcggatataccggttcggaagccttcgccaagaatcaccggttcggtttcttcccagctgtaggagttgcttactatctatccaatgagccattctatcccaaagcaataaagaaaatagccaataagattaaaatcagagcttctgtcggaaaaaccggtaatgatactaccgataaacgttttgtttatagagctacttataatatggcagccggttcatggtcacaaggtataggaagtaacggaggtaccaatgcaataggcaatgctatcatcgaaggattccccgaaacgctggatatcggttgggaaattgaaactaaacaaaattacggcttcgacctaggactgtttgacaacaaagttgattttgtattcgattatttccgctctgaaagaagtcatattctgatgcaaagaaatactactcctactgtaggcggattccgcgtcaatcaatatgccaactacggtattgttaataatcatggcgtagatatgtcactgaatattcatcagcaaataggaaaagtaaaactcagtgcacgtggaacctttacctatgcaagaaataagatcgttgaatatgatgaattaccacaaagatatccttggatggctcagacaggtatgagaataaacgaaaattatttatatatagcagaacgtttatatacaaaagaagactttattgtcagcaaaaacggtagtggcatcgaaacttatactctacgttctgaattaccccaaagcacattggggggactgttaggtcctggtgatatcaaatataaagatataaatggagacggcattatcgatagctatgataaagtaagaggtgtaggacatcccaaagttccagaaattgtatatggatttgggctaaatatagaatataaaggattttatgccagcgcattctttcaaggtgccggcaactgttccgttttgctgggaggtaatacccctgaaggatggtttcctttctcatggggagtagaccaatcgaattaccgtacattcgctttagacaggtggactgaaaaaaatccaagccaaaacgtattaatgccacgcttacataaagacaacaccaatgccgctaataatagtgtagcaagcacttggtggttacgcaacggaggattcttacgtctcaagaacgtggaattaggttaccaattacccaaaaaactcttaagtaaaataaatcttcaggcagccagaatctatctgatgggatataacattgctttatgggacgatctgaaatattttgatccggaagctggtaatgccaatggtggtaatacataccccaaagcacggacatttactttaggaattgactttacattctaattaaatttattaagtatgaaaacaaaaaagaaactatataggaaagtactgatagtagcttttacgctatgcaatctctgttcatgcaactatctggatgtatcagatgaactagccggaaatcttcaatcgttggatgagatatttgacaatgtcgcctataccaaaagatggtatgccaatatttttactgctatccctgattattcgggtatcgtcgctgcagaaggcaacgtcacaggcttcaaaaacccttgggctggtatgtgtgacgaactaaccgttggctatggagacaacaaattatacaataaaacagaaaaaaatgcagcaaacatgggttttcaccgttggggaaattgttataaacaaattcggcaagctaatatttttctggccaatgccaaaccaatagctgccaatggcacccacgtcgatgttctgacagaagaggaacttatagaaatgaaagctaatgtccgttttatgagagcttattatcattatcttttgtttgagcaatatggacctattcctcttgtaaaagacgccatttacgaaagagatgatgacttagatattccacgtagtccgattgatgagattatagcttacattgatcaggaactgaaagaagtatccaatgaactgtcacaagaagctctacatgaggatgaccaacacaatgcgtggcccacaaaaggtgtagcactggcagtcagagctaaactatgggtatatgccgccagtaaattattcaatggcgagtacaaagaagcattatcgattactaatcctgacggacaacggcttttcccagataaagatcccggaaaatgggagaaagcagtaagtgctttgaaagatttcatgacattcgctgaagatgaaaacaattatgaattgttggaaaatgaagagaacccttcacaagcattgtatgatttatttcaaacttacaatcgagaaattatatgggccactgctgccaatacctggggtggtatggatggagatgcctttgaccgcagatgtaccccaagaagtgaacaaaatggaatgggatgtacgggtgtcactcaagaattggtagatgcattctatatgaatgatggttatccggtacaagaaacaagtttcctaaaacagtctacactctacacaaccgagggaacagacacttataaggaaaaagtcgttaccagcaacaataagaaagtaagtgatgccaagaatgtcagcaatcgattcatgaatcgtgaaccacgtttctataataccgtattctttcaaaacagaagatggcacgtcagtaataacgttacccagttccataaaggaagtcctaatgaacttagtggtactatttatactcttacgggctatatgctgtataagagatttaatcgtgaggttaataagaaatcaccgggagttacatcaaaattccgtccttctatcattttccgtctagccgatttttacctgctatacgcagaagctgtcaacgaaatcgatcctaacgatgcacgagtattgacctacctgaataaagtacgtcaccgcgcaggattagaaaatatagaaattttgaatcctgacattgcaggcaaacaggatctgcaaagactggctatacagcgtgaacgccgcatcgaactggctactgaaggacaacgttatttcgacgtacgccgctggatgatagctgaccaagaaggtgaaggacgtcaatatggatacgtgcatggtatgaacatgaatggaactgaagataaattccttcaggaagtagaggccagccccatcgtattcagacgcaaaatgtacctatatcctattccggatagtgaaatgaaaaagtctgatggacaacttgttcagaatccgggatggtaatcttaattatatttcatgattaaaaatataataacaatatgaaaacgatacataccttattagcagcaatgactattgcgatgctggcaataagttgcgagaatgaatttgatgtctccgataaagcagacagtctgatatctgttacagtcaacaccttgaataatcaagcagcctataatgtcggagaaactgcccaagcggaactatggatacaacggggaggactgaaagatgcctccggtaaagttcaattcgttgtagaccctcttttgcttgactcgctgaatcaagaagataaaactaattatgagttattgccggaaaattgttatgaaatgacaaatacagaatttacggtagataaaaacgagttatgcggttacatcacgtaccatcctgaaaagatactggctttgtcagcgtataacgaaacaaaatatgtattgccattacgactcatttctaacgatctggctattaatccagcaagaaatacatcttttcttgcatttaccattttggaacctatcgttcatatcagtaatgctggagtatataatatcaatccggatctaacttctacaatggatatacagatcggagtaccctttaccaataagtgggatattctttgtaatctgacagaagatttatcattgattgacgaatataatcagattaataaagtaaatttcactttacttcccgaaaatgcctatactgctcctgaatccgtaactcttcaggaaggagtcagtcagataaccgcctcctaccaactaaaaaacaatctggtaccgggaaactatattttacctataaaaataggaagtatcacggcaagccaaggaggagttccgaataactcactggtaatagatgaggaaagcaacgttttgttctgtattgtaaaagaagggaataagatcaacaaatccggatgggaagtgatagagtgcagttctgaacatgcagggaatgaagctacatacatgattgacgataatgaaagtacatactggcattgcaaattcaaaaatgaagcaggatcatctgtacctcccttccattttattattgatatgaaaaaagaaattacaatcgctcaaattgacttacttaatcgtggagacggagctgccaataatattaaatgggtagaattttatgccagcaataacaatagtgaatgggataaaattggtgccggtgattttaatgatgaaggtaccagagcaacattccgatattatgtaaagtctaccaaagcacgatatctgaaacttataattcctgaaggatatggaaataactgtcctcctgccgccattcgcgaattgactgtttacggattagaaggtaataattaaaaatcagtattatactcaaaaccttatttgatttaaacacatgatgaataaaagatccctcaatctgctgccttgtgtcgcagttctatgttcttgttctttgcccgcgtatgccgggcaaagttcaaaaaaagaaaaaaaaacaaaacctaatgttattatcattctcgcagacgatttaggttatggtgatcttgaatgttatggtaccacacgtgtacatacccccaatgtaaatcggttggcttctgaaggtatacggtttaccaatgtacatgctaccgcttctaccagtactccttcccgctatgctttgctgaccggagaatatgcatggagaaagaaaggtaccggagtagctgcaggtaatgcaggcatgataattcgaccagaacaatatactatagccgatatgtttaaatcggcagactataccaccggagctattggtaaatggcatctaggattaggtgacaaaacgggtacacaagactggaacgggacaatatctcctgcactcaaagatataggattcgactattcttatatcatggctgctactgcagaccgtgttccttgcatttatattgaaaacggtaaagtagccgactatgattccaccgctcctattgaagtcagttatcagaaaccatttgaaggtgagccgacaggaagaaagaatcctgaattgctttataatctcaagccaagccacggacacgacatggcaatcgtaaacggtatctcgcgcatcggatacatgaaaggaggaggtaaagctttgtggaaagatgaaaatatagcagacaccatcaccagtcatgccatccgtttcattgaagaaaacaaagagcggcctttctttctttattttgcgaccaatgatgtacatgttccccgcttcccacacgaacgtttcagaggtaaaaacccgatgggattacgaggtgatgccattgtacagtttgactggagcgtgggagaaatcatgaaaacgttagaccggctgggattgactgaaaacacactcattattctatccagcgataacggtccggtactggatgatggttatgatgacaaagccgttgagcttgctggcagtcataagccgggtggtcctttccgtggtggaaaatacagtgccttcgaagcgggaacatgtgttccggccatcgtacgctatccggcacaggtgaaaaagaaccaaactttaaacacattgctaagccaaatagactggatccaatcattggcttctctagtaaatgtcactattccccaaagtaaagctccggacagtcaaaatcatttagacagttggttaggaaaaagtaaaaaagatcgtccttgggttatcgaggaatctaatattctggcattatccgtacgcaaaggaaaatggaaatatatcgaaccttccaatggttcccccatgatcacttggggtccgaaaatagaaacaggatatgcaccttatgatcagctgttcgatatgaataagtccgagtttgaaagcgaaaatctggctccgaaatatccagccatagtaaaagaaatgaaagatatattggtgcaggaaagagcaaaagggaaaaagtgacatttattgaaacaacaaaatatatggcttcaccaaaataaacaaaaacctttctatttattttcaataggctaattataaaattcaaaaaggtgtgtcagaaaaagttctgacacacctttttatatatactaattcagctaatcttacttcacttcctcaaagtcaacagtatatctgtatgagcaacttgcgtacacgtgttgcaattatatcacaaatccgaaaataagtatccataagcaacaacaactcttgttcacaaaagtacgatttttattcataaacaacgagatgtaaacgcataaaaatcaaaagaaagcgatatttttaacagattcttcggttttatccttacctttgtattctatattgagttattgtatctgaataataaaatcagttacatcaataagaaaaataggaagaactcgattaacaatataaaacatagtaagatgagaagatttgtaacattcactgttgtatttttatgtgcaacaatagggcttgcccaaacgaaacaaagcgatcaacaagcccccaaagattcagttttaaatagaattgatagccttgttcaaataacgaatgcttggttagaacaaatagaacttgaccattctctgaaacaacgttataaattatatcagacagagaacatatacaccctacttcaattagatactaaaacaggaatgatagaacaagttcaatggtctttagattcagaaaacgaaggtagcgtaactataaataatgatgacttgaattatggatttggtcatggctctggaagttttgaactatatcccacaaaaaatatgtaccagtttattctactggacaaaacaagtggaagaaaatggcatgttcaatgggggatgaaaacaaaggaacgttggattagaagaatttattagtattttcacaaaagtgacatctaagagttatctataaaaacagtagatgcctctaaacaataagaaaacgatgcagatacacaacaatacattgatagcagaatgctcagcttacgatttcaaggaaatgttggaacgtaagaaagtaaagtcgtggcttaaatccgtgtcggctttcgctaatacggatggtggcagtttgttctatggagtgaatgatgacggcataattgtagggttggagaatccacaagccgatgctgattttatcagtgaaatgataaaggcaagacttgaccctgtgccggaaattcaacttattccgatagaacatgaagagcataccctgcttgaagtgaaagtaaaggcaggaacgcttacaccttattactattatcaggatgggacacgtaccgcatatgtacgagttggcaatgaaagtgtagaatgcaactcccaacaattactttcgttggtattaaaaggcacgcacatgacttgggattcactgcctacccaagtggatgccagcaaacattctttcatcatccttgccaatactttccgtgagcaaacccatcaggaatggaatgacaagtatctggaatcattcggactggtaactcctgacagcaaactgaccaatgcaggattgctgtttgtggataattgcacagtatttcaatcgcgtattttctgcacccgttggactggactatataaggatgatgccatcagttccgtggaacatcgggctaaccttgtgctgctcttaaaatatggtatggatttcatcaagaactataccatgagcggttgggtgaagatgcctaactatcgtctaaacctaccggactattcagaccgtgccatctttgaagggttggtaaaccaccttatccatagagattatactgtgatgggtggtgaagtgcatattgacatttacgatgaccgtgtagaattagtatcacccggtgccatgctcgacggtacacagattcaagaccgtgacatatacaaagtgccgtccatgcgccgtaaccccgtcattgcggatgtgttcacacagttggactatatggagaaacgtggctccggtttacgcaaaatgcgggagcttacggaaaaactacccaatttcctgcaaggaaaagaacctcaatatcaaacggaagcgacttctttctacactactttctataatctgaactggggtgacaacggaagaatacctgttgaggaagtggctaacagggtaaacagtaccctcgaaaagtaccttgaaaacgaagaaagttcggtggaaaagttcggtggaaacagcaaaagttcggtgaaaacctttggtgatacgcaagaaagttcggagaaaggttcggagataatccaaaaaggttcggagaaaaagttcggagattcgaaaaacaaatctaaaagcattgggaaaaccgcacaaaagattattgatttcgtcatttccgacccatcaatgtctgcagaagcaatggcctataaaataggaataagctcccgagccgtagaaaaacatatttcaaagcttcgttctatgggaattttgtctcgtgaaggagcagaccatggtggctattggcgcattattgttaaccctcaaactgagcaataaacttatgggaacatctttcatacctctcggtgcaataattgccgttttgattatcgcctttctgtttgcctctttgccacaggtaaaccataaaacgcgatacagagtgctttatgcaatagccattatcatgctattagctgttatccctatcagtgagtatatggctgagaatacaaaaaattcaaacagcaattatctgcttgttctgatattcgatgttgcagtaggttatttctgtatgtacattgccgcattgctgaaattcaatgtccttaaacgaaaaaatcaagcattggaaaatgccttgaccgaaaagcaacaagaaaatatagcaatcctattggaacatcagaacgagaagcaacaagcacttcagcaaagagaacttgaatggttggcagggaaaataaagatgtttaccgaagaagaacagaaagctgttcttgccagtgcttgcgcatttgcagaacacggtttgatagtcactccctcaataaccattcaactcaaagctacatgtagtcagcaagatcttatgtattttgtttgttccgcctttttcaacatgggcaagaagcgtagtgatattgtaagtttcttatctcaggtttttccgctttactttcctgcaggagaaagtgtattggctaaaaagatgccgggatgggaaagagtaaaagagaggagagagaaagaaataaaatcattagttccacattgaaaccgtaccactagcgtttagcaactaatctaatttccccattcaaagcatcctttaggatagccttgataaactcttgagcgtcaatagatatattcatagttttgttattttgttcatactcatattttattgctctaattttcactaagccacaatgggtatctatataggaattctctaaagaaaaaatatggtcttcatctgggcgtaactgattttctaaattatccaatgtatctataatttctcctttcgcattacagatgcttctgtctttaacttgcaaaggaatataaatggaatgaagccatttctcttttggaggaaagtttagacaatctaatcgttctctatatgcttgaagatctaaaccgttttcttttgcccatatatcatccacctcaaaaagacaatgtctgactgatacatttatacaggtttttacttctgcaacaatagcttctccttgattgggtgttctcaattcttttaaacttataccataatggctgccaatttttttagccccctcttggtaaccaatctttgtaaccataattccagatacattatctaaatccgatagcacaccataaaaatcacgaactttactaattggaataggcttgttataatttttgcattcaacagcaactttatgtaatactcctgctatttcatactcccaatatacatctatttgatgtttctgtcctgatttaccaagaatctttatattatgtttgacttttgtactttttacgacatcagcgttcactaattcttgataaatttcttgggtaaatttctcatattctatgttagcattcatatttcgcatcaaattaacttcataaattaaccatattacatatgtaaagatacgatttttctttttatagacgcactttacgagtaaatatctgttagtagatccattggataacatgaaataagttgtataaattgtagataattctaatacactttttaagtcaagagacaaccacagtcaactacagacaaccatataattgaaatatacaacaatataaagtcgttttttatcatcatataatcatatgaacacaattataagatgataatacaaaaagaatgattacctttgcattcaaaaacatatcacagaacgtatgagtaaagacataaatcgtttgaagatggttttagcagaaaagaaacgcaccaataaatggttagcagaacagttgggaaaagacccgggaactgtttcaaaatggtgtacaaataccatgcaaccgaacttggagactttagtggaaatcgcaaaagtccttgaagtggatacgaaggatttattgtggtcaataaaagataataagtaaagagaacagatatcaatgagaaaaaaatataaaggaatagatttgttttgtggcataggcggttttcggcttgccatgaacagtagtcaggtagagtgtgtattctcatctgataatgataagttcgcccaacaaacctatgaagccaattttcatgaagtaccaacaggagacataaaggctgttaatgaaaaagacattccgagttttgacatcttaacagcgggattcccatgtcaaccatttagttatgcaggagaaaaacaaggttttaatgatgaggtaagaggtactctgttctttgatgtatgtcgaattttagaataccataaaccaccaatggtctttcttgaaaacgtaaaaggtttgaaatctcacgataatggcaaaacactccagactgttttggacactctaaagaagcttggttattacccacattggactattttgtcttctttagattatggtcttcctcaaaaacgagaaagatggtattgcgtagcctttagaaccgaagtcgattttgaatggcctaagcctgcaaaagggcatcccgtattgcgtgacattatagacatgaatgataggaatccatctttggctattcctaaatttgaattggacagaatagattatcattttgcaaatgccaagcctggtgatagaatccaacatgacaattcaaaatataagccaaatacgaagaaaggaaaatatggcgttttttcttttcaaaaggcagacggttctttgcgatttcatgttggtgatccagctaaaacacaaattcaggaagcattctattcctgtcttgacacatatgcttctacaattatagctaataggacaccaaaactatgggatatccgcagaaagttgtctgtacttgaatcaaaaagacttcaaggcttccctgatgactttgtgttccctgtgtccgatgcacaagcatacaaacagttaggaaactctgttagtgtgccaattatcgtaacgataatgaataatatgattaaaacttacgaaaaaactcttgaaaaatgaaattcataagtgtaaaatctgtagtcgaggcctacaaaggctttcaagattgtatgaccaataagtcttggggatatttggctctattgaaaggatgcaagagcagtatttgcccctccgtaccttatgaggttaatcttgacgaagtatcaagctttcttgaaaacatcttcaatctgagtcaagcaaaaaaacgatacagtagtggacgtgtattgtacgttgtattctcaaataaatgggataaatattttaatgatcaaggaagacacactcccaatatctatgatgtagcaatttgggcatataggagaaattcttttgaagacaatatgacaaaggaagaaattctccaaaagtttgcagaagagttcaacatcccattaaacattatttcaaacagtttcaacactcattctaaagaaattgagtttacagactctttatattctgaaactgtactcaaagcagaattgaatgctattggcgtcgatgtgtccaaagaaaatattgatgcaaagaaaggaagtgttgtagcagctcctggcgaaataagccgtggtccttttgttcaaacattatatgcaggattagagattacagattatgttattattttacaatcagactacctgtctctttatggtaatgccataaaatctattaatagcatagatcatactagccaaaacaaatattctaattaccgctcctacattaccgccatcaagaccaaacccttccttttgcttgccggtatatccggtacgggcaaaagccgtattgtccgtgaattggcccgtgcgtgttgggacgaagattccactgaatataaagctcagaaacctaagaattttgagatgattcaggtaaaacccaattggcatgattctacagaactgataggatatgtgagtcgtgtcagcggaaaacccatatatgtgattggcgatttcttaagatttatcacaaaggcttgggaaaacttggatgtacctcatttcctttgtctggatgaaatgaaccttgctccggtagaacaatattttgcggaattccttagtgtgatagaatctcgtaaaagcaatgaagacggtacgattactacagaccctatcctgaaaaaaagcacagaagattggtatcgagtattaacggccgaactgacaggaaacaatgaagcattaagaaaccgctttttggaagaaggtatcaccattccacagaacctaatcgtagtgggcacggtaaatatggatgaaacgactttctcattctcccgtaaggtacttgaccgtgccatgaccatagaaatgaatgaagtagatttgtatgccggattggacaataaatatgaacgcattggtaaactgaatagcgatatgcttatcggtatagccgtagaaggtgtggatgtatatgtcgacaacgaggatatttgcaataaggtattggcttatttgcaagcagtgaatgacgttcttaatggcactccgttcaaggtcgcctaccgcacgcggaacgaattcctactttatgtggtaaacaatttaccttacaatatggatgaaaacggaaacgagttctgtgaggatgaggtcatagcaaccgcattggatgagataacaagcatgaaaatcttgtcgcgaatagaaggtgatgatacaaaagtcaagcattcacttcttgaaaggatgattactactatcgaagcgcagttgttagcattgactgaagaagataagaaaatagaatctgtttccatagccaagctgaaagagatgcaagaacggttgtcatccggctatacaagtttctggagttaaaaacaatcagatattcgcaaaggacgatggaactgcttaccataaagcatcaggattttaaaatgattgtcgaatgtgcaaaattcgatgacatttggcataaagccaagagtaatattggagaagaatgcttacactccacttattcttggtcagaaggcgtatcatctgttatcctgagcaactatatcggagaagaaattacgattgaaaacagccaacaagctcccgccatatttttcgacaacaccgattatcctatttgggtggaattcaaggactatgtgaaaaaggctcagtttggttctattctccagagtgaaaatgaaaaattcacttttcgcagacagatattggcaggtttcttgaattatggcaatgaagtcggacgcagtgaaatacaactcatataccaagtgggagcagaaacccgcagttttgtcttctcttttgaggtgttgagtacaaaactcaactatcacgagcattggaaagccattatagaggatattgaacaagagtacagaatgctttcgctcgactatatgcgaagaacctttcatggcttttcgcccgatgcaagcggagagaccccggaaataatctggtggagcgtatttgccaatgagcaaaagaaattcatcaaggcctgcaaaaacattattgaccgcccaagacatcgtttacacggaaaagagacttacaaacgtgccgataagctgacatttgttccctcttgcatagaaaacgaactggcggaacatcgggcagactgttcgcatctatatcgtgtggaagaacgtgtgtggacaaatgatacaaaggaaaatagattcttgaaatttgcgcttggacagattaccgatagatacgagatcctgaagaagcgtatagaagcgataaagaatgcctcggatgtgatgaaagaggatatgcaagccacattggcaacgctaaaacacttgcaacgaaatccattcttccgtaccgtaggaaattacaaggggatgaatcaagaaagtctggttttacaaaaagctaccggatatagtcagatatatcgcacatggagtctgcttcaccgctcttattctctgaatgatggcatataccgtttacaaaccaaagacattgcaacactgtatgaaatatggtgtttcatagaagtaagccatatagtgaaagaaaaactgcatttgtctgatgaagatatagaccacaggaatcgcatggaaatgaacggactatttacatgggatttgggtaaaggtgaacattcacgcatacttttcaagaaagacgatatagaattggcagaacttgtttataatccaaagagtacggagcgagaaaacttatcggcaggtataaaagattggactgtgccaactgtcccccaaaagccggacattgtgttgcaacttaccaagaacgatttgcaagaaggaatgaaaatgacttacctgtttgatgcgaaatatcgtattgacgggaaagacaaaaacggtgtggacgttccaccggaagatgctatcaaccagatgcacagatatcgcgatgccatctattacaaagattatcagtcggatgccttgaagaaggaagtaattggcggctacatcctgtttcccggtgatggcgaaccggctgtagtggcagaatccaagtttcgcaagactatagacgaagtaaacattggagctttcccgcttcgccccaaagacacgcataacaggcagttactggaacgattcatagaagagcttattctaaccaaatcgtatgagaccatatcaaaggtaataccgcaaaaaggtgcattattgcaagtgcccaatcgcctccttatcggtttagtaggaaacagttcacgaccgggatacacacaaagtttccttgatggcaatgccaccttataccatacaggacctaagttccccacgaccatttcattgcatgaccttcattactttataccttatataaagagtaagggagttcgtgatatatatgaaattgtccgtgtaaggactattacaggaaaggaagcaaagcaaacagaaggagaagatgctacagacgacatgcgattagcgtttgagttgcgtttcagccggaagctgtttgacgattatcgaccgatagatactcataagatgattagctatacatttattgacacgacatttgatgaaatagaaaagtgggtagtaattgataaattctaaaatgtacattcaccatactattaccagaccatgattacatcagataaattttatttcaaaaggtcgtatattcaacaaacctttaaattctagacaaaatgagaaattgtgacaaattacatttgtgcgatcatttagtattaaatgaaggcgcttatttctataaaaaaaacgaacttgaagtaggaaaggatagaattcaagaggtatttaattctgtattgactgagatcgaatacgaactatttacaaagatttgtcgtaagagagaaatagtgaatgtacccaacaaacaggaaatctattattctttgcttgttttcaaattcgcaacttacccctcttttttagattttgaagaagaaaattttccaaaaaaattaatggaaaacagattagcatatttgcttattgtggaaataaacgattatattattctagtcaaaaaaaacatatcacgtattagctctttcattaatagcctaacttccataccaactgatactttagctggtgtactggttgacgatgatactgtttttcagcaaatgaaattaagcaatatgaatatgaacgagaatgccatgcgcaacaaatcttatgaagccaacagtttggaaaacacgatgccaatgtttggctctaatcatacagttgttaatacagcacgatttgccaatactaatggcttatgtactgtaaacataaacacctcacgattgacaaaatttggaactaagaaaaacttaatagagttattggagtggatgaatgttttaattacaaaaattgattcatatattccacaagaatcattcttttcacgttttgccaaaccacaatcatggaaaaaacagcaagataaattagaaccggtatcattacttatagatatatttaaacttaattcttatattcaggaacttcactgtacggatgtttttttgaaaaaggaaggcgaagaagaatattttgcaaaaacaaacatctttgcaaaatacataatttctggtatgaagtgtcttactttagatgagaaagaaaaagatatttataggaaaaagggcaaacgtaatattggtgtaaaaaagatgaaatcaggcttgaagattgtggcatgtggtaatttatttgattctttgtatttttgtgaagacgatgggacatacgtgaaaattattgatttgatgaacaacttgggatgtttttctgtcggtttttcgaattattcatacatatatatgggtaaaaggctttatatgaatgtaggcatacaaaaagattttgaatcgattctttctattttatatccgatgaatgagattgctgctgtcacaagcgaaaagggtgatggatatgacgcaacaagtacagattttaaaataggctcaatgtttaatgttgtagaaaagaaaatatttaatgatgcggatttcttattgtgcgatgatttgggtaacgaatgggcagaccatatagccatcagagaaaattcaatgtcttacattcattctaaatgcaatgatggaagcgcaactctttctgcatccaagtttcaagaagtaatcggtcaagctataaaaaacataggcaatatgaatcccgatgacaataccattcaagagaaaatgaaaggaatgaatggaaaatggaatggaaccaatataaataaatgtagaataggaatgccggcagattatgaaaggttgtataaaaaattgagatataatcccaataaagtacaggaaatctgccttgctgtaaattatctatctaaatctgcactagccgaggcttttgataaaataaagaataatcagccgctaaaacagaaaaataatgttgtgcagcttgtttggttattgagcggatttatttctacttgcaaagaagcagatttaaattgccgtattttttgtaaagactaggaaattaccaaaactttaatgattttataagttgtagaagccataccagccaagaggcaaagactaaagtgttaatagataatactattttagatggataaactaacaaaagaacaacgtcatcgttgtatgtccgctataaaaggaaagaatacaaaacctgaattattggttcggaaattcctttttagccgtggcttccgctatcggctcaatcatccacgccttcccggtcatcccgatatagtacttcgtaaatatcgaactgtcatttttgtaaatggctgtttttggcatggtcatgaaaaatgcaaatactttcgtccgtctaaaaccaacattgatttttggcaaaagaaaatagaacgaaacaaagaacgtgataaaaaagagcaatgccaacttgctgctatgggctggcattgcatcacgatttgggaatgtcaactaaagcctaaagtccgcatggaaacacttgattctttagcgtatacattaaatcacattttccttgaagatagaaaaattagaacttaccaaatagcggaaactaacgatagtcttatggttgcagaaccagaaactccatatggaaaaacaccctaatgatatatgccccatagaatgttcatcgttctttattaaccttagattgtgaatgatccgcttccatcaaatgctgatactgatgctgttctttcaccgcccgatacatcgaataatgtgcaaaggattcttccttatatttcatactactaatagaagcagcaacagtccacattagaataacgacaacgaaggccacaacatatcgtagcttaatatgatatccatgtataaacatcccattgatattgggtggaataaccgttactggatttttcaattcattgattctcgcaagtatctcgtcctgccgctttaatatgcaatcggtatttgcttcaatagtcatacgattgagattgtaatcgcaaacgtgtctataaagatattcaagaaatttagacttctgcttgaatagttcaataagcttcggaaaccatagcgaaaacggcaatgtatcaggttgctgcttccagatatgtttcttcaccactgataacgcatcattccaacaggaacagaaacttttggcgactccattataaatggtcttttcgtcaaagtccatttttacagattgctttggtttaggaactgtagtattctgtttttcaatacactcttttagctcgttgatactttggcgcaaattcgcgagatttgctgctactacatcttctttcattatcttctacgttttgagggtttataaaaaggttcgtttctttggttatccttgtctttgtcgtctcgccatccttgttcattatttgttcctccagctccaacggaagttatggcttgatgaggttgaacaatcagctccgttgccacattgcccaacgtaacgcaaaggctgttaaaactcaaatcacggtcaagtttagaaccggctatgctatattcatcttgacaaaatgatataccacgaattttatcagagttatctgcactattaaaacgcatatctataccttgacctttgagaatgtccaaaaagtcatgccatgagcgagatgccgccaacgcatcaagagttgaggaacgaagattatacttccgtaattgatgagggcgcaaacggctcttatttctcgctttgctgtttttaggagcaaagtaaagtttatactctttggttaaagcacgacagacttttgcatttcgtatccgttcgttgctatcagaaatgagattaccgtcattgtctatccgattgaacaccaaatgacaatgaggatgtttcgtgtcgtgatgtcgggctatgatatattgagtattgcgaatccccatctgctccatccatttcttggctatctccaccatcagcgcatctccttcttcgttatcgaggaaacggctaatgtcttgcgaagaaaaagcaagtgatacgtgtttcaccggactttttactttcgggcgtatggacgcttgtatctgaaacgaatcagctatggttttattgctgatggcacagacaccttcatgtgctaaaagtgtggcacatttcttcttgttcttctggtcattggcgtaattcactattcctccgaaatctgctcttgttttaatctttgctatcatgattgttattctttacttgggtgataattctactgacttctgatatgattgaaaagcattgttgcttgactgcttccaaaccataagtgtgcatctgatgggctatctgattgacattattggcgattccggaaaggtcacggattgccgatgccattttaggactgatgcgttgacagacttgacaatccattgctgcctgatggcaaaattcattgacagacaagcctgcctgctccgctttggattggatataaatgtagtcgttctcggtaaacataacccggaaacatttcgtgcgtttctggtaactcgccaacttagggcgaccaccaagtttcttttccttcatacttatcttaactttgatgttcataaattgattttttgagagtggcagttctatccgcttgccgcataggttttagtgacactaaaacacaaacttgccactcaaaaaatcttcctatatttcccttgttctattcggcttagttttccatctttgataaaggcttctatccacttgtttgccgtacttccattttcgcccaaagatgaaaccagtgtatcataatccttctttgtgaaagtatcgggtaacatattataaaggatgttccttcgtgcataaacgcctgtctcttgcgaaacggtattgaatcgtttaaactgatttcctgacaaattctgataaatgaatacggcatgataaagcagggtgtcgcaaatactcatggctatggaatagtcaaactcatggcaaaccaattgtacagtctcgtcagaagaagatttgtgaatcacattatccaaatgtcggacagcggtcaacaccatcattatacgataagcaatcagtcccatccgtctgactactccttgcatcttgttatccacttcgtcacaacattcctcattcacacgactgagatattcaataaactgttcctgcaaatcagagggaagagaaaaggaataattaccctgccgtacaaattcctcatgcaaatgacagaatttatctcccaacagtttgaacatggcattcttggattgggaaatgtcgcttgtggcaaacacatttcttatacctcgtttgaagcggataatatagaaacaaaagcgactcatcaatccgttctccgcatcaggtatcaatcgtcgtacttgttctggagttccagccaaagctaccgaaactctcggattagctacttcgcaatactccctgtctttgcgccaactcaaacttaccaactcatggtgaaatgcctttcgcaacacatcggaatagttaccatagtcagacttcaaagtctggcttaacgtgtcaccctccgattcaaataacaatccgattccgtcattatctcccaatatcttcaggaaagaacttgcgctgctattggcaggaatgacaagcattcgcatgggcggttcggcaggcatagacagtctgctatctttcttgcctttgatataagtattcatcgcttctttgtattcctgttccaatcgtttggaaagttcatgcaaattacggttgatgggagctacaagctctcggcacaaggccaatgctccttttcccataccggcatctgccaccacgaacagatatagattcggataaacaatacgttcatcgtacacgccacaaacattatgaaagcagaccgacaaacacacaatagccccaatcagtatcgtatcacggtcatctactgaaatggaattattgacaacctcatttagaaaaggaggaagatgctcaaacacacattcaggaaatacaggaagttcttcttctgattttatccatttacccgttttaccattttggatatttggtaaaatggataaatactctttactgaacggagccaatgagattccggcttgatttgccaaatggaagaaagaacggatagtaatgccttgccctttggagtgcagacaatacgtatattgtttatccgtttcttccctttgataggtagggtaaaacctgctgatgcggtggtaatactcccgcccgttctctcccaatccatctacaagcgcaaaacccaactccacccaatctttataatgaggagctatatcaatggcacactgttctatctcccgaacaacactttccacatcatcctccaccttattatatataggggcaatacgtggcgtatgtatttgctgtatttcagaagggacattttcccaatcttgggcggaaaatattttcttcgacatcatctttgtatttatggttaatatatgcttgtgggtcgtaaggtaagaagcatgaacgagccacatcactgccagacatatccactaatggcaaacctgtcgctttgatgtagttggcaacagccttgaagtaccgagaatgttcccagcctttcaagccaacaggtattatctacttcaatccattaccggatggactgacaaataacagttctgtatcaaaatactcatggttgagtagttgctgttttaactcccctatgttatccacatgatcgaaatccaaacacatcaatcctgagtgcataatcagttccttctcattacgcttgcggaataatcccgaaaaggtacaatagtcaaaatgagtggctttgtatcttttagcttcggaagaagacatcatcaaacgcagggcttcagtttgtggttgggcataatgcccgatgatataacgatacacatccacaatacctaccgcccttatcggttcgatgttttgaatgggcttgcgaaagaatgaaaaacaatagtctgtcgtctccatcatctgataatctttttagattcgacaaatcgtttggcttcttccattaaatcatcttgtgtcttatgcgatttgttcttcaaccaatcgtcaatctcagattgcagaaaagccaacgctttatttattttatgtacgggaatctgtttggttgatacccatccataaaccgtttgcttggctggatgcgatggcagataagcgcaaagctcgtctatatccatccacttgggtgaattacttgcttgcttatgctgcaaggcatttactttggtttgtagtgcttctacagactcaatcaggtaggacaacgcatttggcatctcctccaacgaatttactttataagccattttcttcgtatttaagttgatgccgcaaaagtatagggatgcttataggtgctaaataggtgcttgaccgccaccaatcaaccgctcatttaccactaacagatttaagtttcattaatacgagaatttattggaagacataataaaaggggaataaaccactattgggaccaacacattccttatcgaaagcttcaatctacaaaatacccctcaaaaagccgatgcttcatgaggggtaaacggtggtaagtatatgattggaattacataagtcattggtgctcaatggtggatacaaccaccacaatctataaatccaaattttctatatgcagtgtattggcggctttctctttttgttcgtttacgatgtgcgtataaatctgcgtggttttgacgtttgtatgtcccatcaaagacttgatggtgtatatgtcaacgccattttccagcaacagcgaagcatagctatgacgtccacaatggaaggtgatgtgcttcttgataccggatgcttctatccagactttcaacggacgagaaatccaagaggcatcagtcaatccttcaaaaacaagtgcttcatcatcgtctggacgtatgccgcatagttgaagtgcttgttgaatgacaggcttgtaatcgggcctttttgtcttttgctgaattacgactgcttgccatgtgcccttgcttgtttgctgaatttgtttccatttcaaagtttgaatatcactatgccgcaatccagtgagaatagagaacaagaacgcacgtttcaaaacatcatccttgcaaggagtatcaaccaacatttgcacttcatccatggtaagcgcaacgcgaggtttctcaatgtttgttattccctttactttcgcgcttatatcaacggtcaggtattcatcaatgaacgcctgtttcagtccggctttaagtatggaaaaataggttgatgccgtgttttgtgagatagtacctttcttattccctcccattggagcacggagcaggaacatcttaatatcttcaagcagtttaacggaaatcgccttgaatggaattggctgcccttgtgaatacattttcaataattcgcctacacgcctccagttgactataatcgaatcggaactattgggatgacgtgtgcttataataccattgaaatacttgataaaatcctgttcgctccgctcattctgtgcagcgatttcgttttccttatcagtgaagaggatggcactatcatattcatgttggcgtaacttccgcacattgtcggcatagatacaagcctcttggtctatcgttgaacggcattgaataattccattcaagtcacgtttaggcttataattgaatgttccatccggcaagatacgtgctatggatgacttatcccaaatgggtgtggatatagtccggttaatggattccaccacacggcttgcgcgggttgaacctcgtttgtgcactgggtacgactctataatcagataccactcttctttataattcgaccttctgagtttgacggtcactttggtattaggtaatgctttcttcattctacttctgatttatatagattatcaatttcttgcttgggtacatacacatagttgcctatttgtcttgaaggaatagagtattttctaatatgtgcccatactgaactgtcattaatatggtacttctcacaaatctcagtaatggtatagcaatcctccggctctaagctgtatgttttaggaacaggcttttctttctctgcgatactttccggtctgtttataaaaagccgttccatttcagagcgtttgatacgtgtgagccttgtacccatgttgatagttggaatacgtcccaatttaatcaggcgatacagggtgctacgttccaccccgaacatagcgacggcttcctttacagaaatgtactctctgatgtctgatacttgtttggcaatggcttctaacttcgtgtttctatcctttgcatcctttttgcgtttccaagccactttaccacatttaggggaacaatagtgactgtcaagtgtttttgcgacaaacactttgccgcagagcttgcacttccgtttgatttcaaatccgattgttggcatgttatctacttttaagtatgtattagtatgtataaatgtgattaagtaccacattatctacttttttgtcttgtcgcaaacatgtcgcaaataagagataaaaaagcccatagaaaacacataacaaccatgaaccccataaacgcaaaaagcgtgcaactcattgagctgcacgcttttgcttattgtttattatctgtatccttatcggaatcatttgacttcctcaaagataattattactgtatatcagtgtattatatataacttggtacaaatatgattactttacttcgtttactctatatttcagccttagcgagaatagaaaagctaccgcaaaaaactttaacctagtttaactatgctgtttttgacgatttctattttctcttgttttcagatagtcttcgatattttctcttattatgcttttattttcataagctattgatttgcaaaacggtatatatttttttctttcgttttttatgaaaaagtattatacctttgcattgagaaataaaaaacaataggcatgaagcaaaaacaatatatactccattctttgacaatagaagtcattgctgtgctactggcttcaatgattgcgtttcaaatatgcaatatgctttgcatacgaatgagtctgcttccgttcgttatggctgttggatatgtgatactgaaacttctatatcatctttgcatctctgtagcaagatacatcatagaagcccctttatcacatttgacattagccaatgaagtgacagataaagagacatcgactgtcacatcattacatacccaagattgtgtagatgtacaaaaaaggcgtatggaattattccattatgaataccaacatgagcaacaacaatacaagcaacaaaaagaaagagaggaagacgagaaattaaacgctattctgaaatacacacgagatacattcaagcgttttaatttggacgaaacggagattttccagatttgcgaatctgtccgttattttgtgactaatcgccaagtgctttctatgaccgagattcatattaagaaacatagttcgctcacacaaatctctttaaagaattttgcttggaacatcgctttccaatataatataggtggagatataactacatcatttgtgatggcaacatttgccgaatggtttaccaactccacgtttgacactgtaagaaagaatctgcggactactactggtcgacacaaaattgaaattgacgaaaatatcctatcgaaatacgctatttaagccatttttcgcttccagacaataattattatcggaagttgcttatgttatcagactatttatataaatttgctcttgaattaaaacattttacctcatggctaatttgaacagactaaaagtagtacttgcagaacaacagaaaacaggaaaatggcttgcagaacagattggtaaatccaattgcacagtgagtaaatggtgtagtaattctgttcaaccagacctcaaaacccttaatgatatagctaatgttcttgatattgacgtgaaagatttgattgttagcagtaataaatcctaaaacaatttattatcatggaagtaaacaagaaagaactcaaagaacaagagatacgtactttgttcattacccctgcactccaacaaaaaggctgggcggtaagcgtaaatatgcgtgaagagtattatttcacggatgggcgagtacttgttgttggcaaccaacattcagtagcagaaggaaaaaaggctgattatctgttataccataaaggtaagcccattgcagtagtagaagccaaagacaataaacacgctgttggtggtggtattcaacaagctatggattatgcccaaatccttgacttgaaatttgcgtattccagtaatggagatgctttcttggaacatgattttatcacagggaaagaaaccgaaatcaagttagaaaatttcccgacagaagaagaactatacaatcgttatcttgcatccaagaactatacatcggatgaacttaacataatagaaacaccgttttattatgatgcccatagccatgaaccaagatattaccaacgtatagcggttgaccgtacagtggaagccattgcaagaggacaacagcgtgtacttgtcgtaatggctaccggtactggtaagactttcactgctttccagattatccatcgtctccataaaagcggagcaaagaaaaagattctttatcttgcagaccgaaatatcctcattgaccaaacaatggtgcaagacttcaaacctttcaagaagtttatgactaagataacttctgttggagaaggtgaagaaaaaattgattcatcatacgaggtatatatggctttataccatcaactagtcggaaaagaaggtaagccagatccattcttagaagtgcagccaaacttctttgatttgattatcgttgacgagtgccatcgtggtagcgcaaaggacgattctgcatggcgcaaagtattggagtatttcagttcggctacccaaatcggtatgactgctaccccgaaagctgatgaaggagcaaacaacttggattatttcggagagccggtatatacctattcccttcttcaaggaatccaagatggtttcttggctccatatcgggttactgccgacttcatcaacgttgatttacagggctggactcccgatgaaggtgaaatagatttgttaggaaaggagattgaacagaaattatatcaaagacagaatataggtcgtgaccttgccattaagttaaggcgtaaagtagtagcacacaggattacccaaatgttatacgacatcggtcgtatgacaaagacaatcgtgttctgttcggatattgaggaagctgccgaaatgcgaacactgcttatcaacatgaatagtgatttatgtaaaaaatctccttactatgtgacacgcattgtcggagaggacaaagaagggaaaaagcagttagacaactttatcagtgttgacgaaccttatccggtaattgttactacctccgaactattatctacaggagtggattgtaaaacttgcggcttaatcgtcattgataaagaaattggctctatgacagaatttaaacaaattatcgggcgtggcacacggctcaggaaagataaaggtaaatggcatttggaaatccttgacttccgtaatgccacagcaaaattcaaagatccggcatttgatggcgacccagaaccaccaaaagggggtggaaaaaagcctaaactatatccgcctgttcactcagatcctccaacagctcacgaacctcttgaaaagtatcttatcaatggtaaggatattcgtatagcccatgagatagtatctgtattgggtgaagatggcaaaaccatgagaacggaaagcgttcagtcattcgcaagaaagcaactgttgcgacactatcaaagtttggatgatttcgtacaaacgtggactgaagcagaacgcaaacaggcggttatggatgagttaaaggaatatgccatcttgatagacgcagtacgtgaagcaaatccagcattgaaagatgccgatatcttcgatgtgatatgtcacgttgcatttgaccaaccaccattgacgaggaaagaaagggctaacaatgtaaagaaacgtaactacttcgggaagtacgaaggcaaggctcgtgaagtattggaggctcttcttgacaaatatgcggagaatggtattcttgattttgaaaaggcaaacatcttggaaattcctccattcaacagcatagggaaaccaactaaaatcataaaactatttggtggcaaagtcgcttttgaacaagccatcagagaacttgaatatcaaatatataaatcagcttagaaatggcagtaaacaatatcataaagcgaatccagaatatcatgcgtcaagacgcaggtattaatggtgacgcacagagaattgaacaaatgacttggatgttcttcttgaaagtctatgacactcaagaagaaacatgggaatacaaagatgagaattataaatccattatcccggaagagttacgttggcgtaactgggcaatagataaaaaagacggtgaagcattgactggagaagccctactctctttcgtcaatgagaaactgtttcctaccttgaagaatctcccgatagatgccaataccccaagagctaaaagcattgttcaagaaacatttgcagacttgaaccagtatatgaagaatggaacgcttctgcgccaagtggtcaacattgtaaacgaaatcgaatttgacgatgctgacgaccgtcacacattcggagatatttatgagggaattttgaaagatctgcaatcggcaggaaatgccggagagttctacacaccacgtgcattgactgattttattgtgatgatgctcgacccgaaattgggcgaaacctttggcgacttcaccagtggaacgggaggcttcctcacctcggcacttaaatatatgggcaggaatattggctctgcggcagatggagaaaaactgcaaaatgccgttgtaggtcaggaatggaaaccgttgccctaccttttgagcatcacaaacctgctgctccatgatattgaagctcccaacataaccaactgtgattcgcttggaacgaatgttactgatttcaaggaaagcgacaaggttgatgttatcggcatgaatcctccgtatggtggtagcacggaagacagcgtaaaaagcaacttcccagtacagtaccgttcaagtgaaactgcggatttgtttatcgcccttatcatgtatcgcctcaaagctggtggacggtgcggtgtgattatccctgatggtttcttatttggtacggatggagcaaaacttgcacttaaagaaaatctccttcgcaagttcaatctacatacaatcatccgtttgccgggttctatattctctccatacacatctattgcaaccaacatccttttctttaataatgaagaagccgaaggttgcgaagaaggattcaagaccaaagaaacatggttctatcgtcttgatatgccggaagggtataaacacttctctaaaaccaaacctatgaaggtggaacacacgctgcctattcaagaatggtggaaagatcgaaaagaaatcatcaatgacgaagtgggagaaaaaagccgtgtattcactgcccaacaattgatagacttggattgcaattttgatcaatgtaagttcccgaaagaggaagaagaaatactccctccagcagaactgctcaaacagtattttgaaaaacgtgctgcgctcgaccatgaaatagacaaaacgctttccgaaattcaaaagattctcggcattgacataaaatcgtgtaactgataattgtgaagtgatatgaaagatttgaccatctcaaacatagaaagacaaaatgtacttaacaaccgttttgcggtcagcaaagtacaggagcatcttgacattgaaggaatgctctttgagggagagtatcgctttacaaaaaaaatggttgccgatttctacgaagtagaagaacgaaccatagaacgctatttggaaaaacattcagatgaattagcagctaacggttatgttttatgtaaaggtaaacatctgaaagagttaaagttacaatttgctcccgtcataaatgtcgggagcaaaacgacccaacttggattgtttaatttccgctcattcttggatatgggtatgttgcttacagagagtgagaaagccaaaaaagtacgtagccttatcttggatttcgtgattaccaccatcaatgaaaagacgggtggcggaacaaaatacataaaccgcagggatgtacattatcttcctgctgcaattacagaagaaaactatcgcaagaatctcacttctgccatcaatcaatatgtggacggacatcccacatacaaatatcctcaaattacagactttatatataaggctgtattcaaggagaatgctaaggagtatcgggaagtattgaagttagattccaaagacaatgttcgacacacgctgtattcagaggttttattggttatttcttcttttgaaaacggtgtgggggcagctctcagtgaacggtttaaagaaaatggtggcaggttacttaccattgacgaggtagagcgcattgtgaatgaacttgccgaacatccgatgcagaaaccttatttaaatgatgccagaaccaaaatggcttcaagggatttcagtttccgggatgcgtatcatggtaatatagcagattatctgcaagctgttactcctgaagagtttgaacgattcatcggtgaccagtctattgattttgaccgtatcttagcggacaataaagatgtgcttaaacgcttaaagcaggcagaagatgagtgaggaaattgtttatatagactacgatgaagccttaaccatctatggcaaaatgattgatgctagcgatggtggctttgaaggagtgcgtgatgaaggtggcattcgtgctacattggattttgtacaaaatgatttatactatccgacctttgcagagaaactgacctatctgatgtatagattctgttctgggcatttcttcaatgatgggaataagcgtattgcgctgactttgggagcttacttcttacacaagaataattactactggcacgcttgcatctgtatgcgtacattggaatctatcatttatcatgtggcagcatcgaatatcaaccaagatttgctgctacgcatcgtcaatagctttttgacaagtaaagattatgacgaagaactgaaaatagatattgccaatgccatgagcaaaggagagttaggaatacaaggggaggattacgaaaaagattaaatatgaaaactataaaaattatcttattactgttctgtattattttaggaattaacgctaaagcacaaacagtaggttatacttataaagcactcgcagctgaaggttgcaatatgaaatacagtgtggctaagcaagacaccatttattctatagtagccacagtacgttcagacagaatgaaattcctcactaaaccaaccatgaaaattagaacattcacaggtaaatatctagaactaagaggaactgtgattgggaatggaagtcaatctgctggtgttataagtggaaatattgtaataccaatcacagaaattagttctactgctcaatttagaattactccacagcagtttgaaattttgaatgaaggtgtggcaaaaattcgtttgtctatgactcctatgaatcatgaacgtactttcaaaaaagataagatagggaaaaagttatatcagttctatctgaatgaaaaacaaaaagacgaaaacttctaaatcagttagaataagatgaacggaaaacaattaaaaaacagcatactccagtgggcgatacagggaaaacttgtaccgcaagaccctaatgacgaaccgacatctgtacttcttgaacgtatcagagccgaaaaagcacgacttgtcaaggaaaagaaaatcaaaaaggacaaaaacgaatctatcatttaccgtggtgacgataattcctattatgagaagtttctcgccaccggagaggtgaagtgcattgatgaggagatcccgtttgagataccttcttcttgggaatggacacggataggtaacatattcaatcatacaagtggcaaacagcaaagtagtagcaacaagaatggaggaacaccacagaagtttattactacctccaatctctattggggatattttgtccttgataatgtaaaagtgatggattttacagaggaagaaatcaaaaacagctctgctacaaaaggcgatttgcttgtttgtgaaggtggtgcaggctatggtcgttctgctatttggaatgaagattatgatatttgtcttcaaaatcatgttcatagattgagaccgcttgttgatgaaacttgtgagtatgtatattacttcatatatctacaaaaggagagtaataatctagcttccgtaggaacagctatgcctggattatctgccaatagacttaaacatttattagtaccattaccgcctatagcagaacagaatcgaattacaaagaaacttaaagaagtatttcctgtagtcgaaaaatataataaggtgcaagatgaactaaacctcttaaactcttcgctcaatgccattatcaaaaagagcattttacaagaagcaatacagggtaagttggttcctcaaatagcagaagaaggcacagcccaagagttacttgaacagatacagcaagaaaagtcacagctcatcaaggagggcaagctaaaaaagtccgccctgtcagattctgttatctataaaggtgacgataacaagtattgggagaagaatagtaaaatcgaaaaagatattactgacgagattccatttgaaataccagattcttgggtatggtgtcgtttgtccaaccttgtcttattgctctctggaagggatttagaactaactcaatacaattcggtttcaaatggcatcccatatatgactggagcaagcaattttaagaatggtatcttgattaaaaatagatggacggatacgcctattgtcatttctgtgttaggagatcttttaattacgtgtaaaggtacaattggagaaatggcatttaatactattggtgatattcacattgcccgacaaattatggctattagaagtagtttcgtggatttgaattacattcaatactatctaagtgcgaatctccaagtattgcaacgacaagcaaatagtatgattcccggtatttcaagaggaacccttctgaatgcaattgttccacttccaccactaatggaacaagctcgaatcgttgcaatcattaagcatttagcaagtattatgagcaggtaggcaatgagaatattgatataacagaagaaataccttttgatttacctgataactggacttgggttagatttggtcaatatataagaatgtctatcggaaagacaccaccacgaggagaaactaaatattggacgaatggtaaatatccttgggtttctatttctgatatgtctgattatggattggttacaacgacaaaagaatctgtttcagaaaatgccaaaagtttatttggagaaatatctcctgccggaactttaataatgagttttaagttaacggtaggcagaacttctcttctaaatacttcggcatatcataatgaagcaattatatccatttatccttttgtggataaaatttatcaagcaagaaattatctgtttcacattttgccgattatatctaatcttggtgattccaaagatgccataaaaggtaaaacattaaattctaagagtttgaataatcttttattgccacttccgcctctaaatgagcaaaggcgaatagtggcaatgatagaattattatttgataagttgaaataaattatttatttgacaagcgatacgctgctgttctgctaaaggtggaataccaataggcagattgtaaaataactctttattgaggtgcggaatagccgcacctctttttgaattcctcaactcatctttatagaacaagatgaaagccaagatataaggtttccacatgactgaagaaagccataactgtttgaacgtactgcccatatatccattttgtggaacagggaaaacttctcctgaattttcaccatctacaagaatgatattgtctccggcatagacaaattttcctttctctacaatgctcgcagatgatttactacgcaagtattttgcatccagacaaataccctttccgtttctcttttctccgtctgttagttggcatacatctttcaaacgtaacaaaatccaactatttggatattctaaaggaagctcaatttcaacggtttgcccgtttatcctctcataatacttgttatcgtcacctttgaagataatggaatctgacagggcggacttttttagcttaccctctttagcgagattatgtttctcctgccgtatctgttcaagcagttctttcgctgtgccttcctctggaatctgaggtacaagtttaccttgtattgcttcttgtaggatggatttctgtaaacttcgtgctaaagaaagctcaagttctgctctgtctgatagaagcttatttaatttttgagatagtgtatgcatcgctttatatgttatgcgatggcgataatcttcccataataggaactcaatgaatttggtaataccatacattattatgataacgaattgtttaactaataatgtatcagacatgaacattgaaatttttgaaacgtatcttcgtcaaggaaatatggcggagaacacgattgcggcttatctctacgccgtaaaagagtattattcccgacacaaggaactgaacaagcgtaatttgcttgtgtataaaacctatcttattgagaaattcaagcctaagactgtgaatcttcgtattcaggcaatgaacaagtatcttgacagcgtgggaaaatctcgtttgagattaaaatccgtcaaggtgcaacagcgcagttatttggaaaatgtaatcagcaatgccgactacgcttttctaaaaaacaaactaaaaaaggaagaaaaccaagaatggtatttcgtagttcgtttcctcgctgccacaggtgcacgagtcagtgaactaatccaaatgaaggtggaacacgtgcagatgggttattttgacatctacaccaaaggtggcaaaatacgccgtatctatattcctaaaactttacgcaaggaagccacagaatggcttggtaaagccaaccgtataactggctatctttttcttaatcgctttggtgagcgtatcactacaagagggattgcgcaacagttgaaaaactacgcagccaaatacggattgaatgagaaagtggtttacccccattcattccgtcatcgctttgctaaaaatttcttggagaagttcaacgatatttctctacttgctgacctgatgggacatgaaagtattgaaacaactcgtatttatttgaggcgtagcagtgccgaacaacaagagattgttgataaggtcataacatggtgatgtatttggaaggttggtcaatccatccttccaattccttaaaagaacttcatatagattatcaatcctcccaatgtcaaacagaaatacgcatacaatatccagaatccgacaacggcacatttggctattttgccattaagagaaaacgaagtttcagatttcacacatttatggacttctttccagtgattcgtatgaagtgacttcaattctgttatctgcttctcaaataaagatttttcttcttcaatcaatttattgcgatattctgtaagaatagacttgtcttcatcgctaagtttgacatttataacagtattctctgcctgaataattgcacggctaatagtatcagggatattgtcggatgttttcactgcagtattaagaacctgtgctgattcttcaaaagttaacactgaagcatctacaaatgcttttatctgtttcaattcttggataacatctttgatgtccttaatctgattcgtgagatttacaagctcggtttcaaaatcaacacgattttcaattttgctaatgttatcatcactatctatgctcttgctatcctgcacaggcaaagaagattggtcatatttacttttacgcatggttatatgtgattataaatgaaatactatctacccctgctacgtttaatcggtttgcagagccattttgccatttttgcacaacgaacagcccagttacgctcatcatcgtccttatctttaccccatccgctaccgggactgccaccacctccgcttgaagccgccatagaagtagcagcatccaaatatccggcaaatagtaaggcggcaactttgaataaattggtctgtttgacttcttcatcaaggcttccaaactcttcgtcaaagacagacttaaccatatctggtatatcaacctcgagttgttctccatccactgttatggaatagtggtaaatagaaggctttgattgtggcatcacctctttattattatgcgccatcgtttgagtacatacttcctttgactgaattgcagtttgtttatcagaagcatgtaatcccacccaagtcgcttcaatttttgatggcatcaattttcgacttttacccaatatcgaggatttataaatagagttcccttttcgtatagcgtaccctttgaccacttccttatcgtcctttatcaacttaatatcgtaccccttagcgtttaacatttggctataagtttcccaatcaaattctggcatagctttcaatattgcgatgcagtcttcactgatttgctgaatattctcatcacgacgttgcacggattgcacccagccacgtctctcattgatgatgttggcagcatgaacggcacgttcaccaatataatgcgcatcgtttgtcttgtccatattgtctatgcggttagctacaatatgcaagtgagggatgccacttttgctgtcggtgtgtaacgaaacaacatactggctatttttgatattggtcggtttaagatgactatctggtttgccacatcttcggtcaatgccgtcaagtactgcaataaactcatccgccaaattctgccaatccgtcattgtccatcctgccgattcttctttggctggagatatttcaaagcgcagtgcgttcagctttatgggcttcggattatatctgtctttcatacattgatgctggtgttgcatcatccgtgaccacatagccaaaggttctatattttctggcaagtcatgcaccttaacgagctgggctttatctttttccatagaatactcaatggctcttgctccatgagaaattgcctttccttgtgctatcataatttcaaatttgatttatactgtctcgtatttgtccccatcggacaataagcctatttactgcctctatccaagcacgcatataattctcatctcggaaatatcgttttttaatctcatcaggtttacctttgagtacattctgaatgcggataaggtcggctcgtgcatccgataaagagttcaatccttgtacttcctcgtctgaaagtcgtttgtttggatggtgattttgcaataattttcgtccgtagttactaagtgtcagtccacattcggcagctttttctactatcatttcatactcattttcagtcagacgaatgtctatatgacgagtacgaacaccctgttttccattgttttgttgtatatccataagcgtttataactggaatttattaataaaatgttctatccattgcgagcctgcgagtaatgcaagaagcctccaagacgacaaatgagtgaaaccattttgtcggacggtggtacttcttgcatagaatacccattaaaaatggggcattacataccttaatgcaagcattgtctttgtccgaactatgccatttgtctgtcaactttaagagtggctattgtcacctatatccatttggataatcaatagttttactttccccttagtttggcttctccaaaaacacatcactaaccggaatccaccagttccaaatgcaagcagtcaatcaaagtttgtaggtttggatttcgctttatcatcttttgaagtatcatcgcaggtgtttcagtcgtcaataagaaatccgcaatatcaagtccgttcttgcgctgttcgtctgtggcgcattgttccaaactatcactcaatacaactttagaacatacggaagtgagtaaagccatcttggtttgccaaacctctcttgcacccaaatccgggcatagcataaccgaccgacctttcaatacacttaccacgtcagacttgaagcatccatgcattccacctgttgccaaccatataaattccggcatataatgggtagctatcaaagcggatttttcgctttccacaatagcaacaggtttggtcggattctcagataacagatgttcgccaaacaaacattgcttcaaattgtagtttgggagattcagttctgtatgtacccaactaacataacttcttggctcttttgtccgatgtcctgtttctgcatcatacaacattatcttccctgttcgtacattaccttgccaatcaatttgccaatagacagtagaaccgccccacttctttgatgtgccaacatgatatagttggaatatccgagaagtctcatctttacccaacatcctagacaggtagatgtacaatggattcataccgtagttagtaagagtacgtttcattagttcattgtcaacaaaagaggttggaggcagtaaattgggcttaggcttatcggcttcaatgaagttatccttgttgtaatccactaccattgggttatcatgaaaataatccgatggagtgtaatggtattggcaagattgctcatggtcacatctgcctacataatcaggaaaagttatttctccttggctatctatgtacttgacaaaacattgtttctttccacacttcgggcatgaaagttttgacccacgcttatatttttgaagagaaaatctatattcagccatacttcttcattttgttattgcagtccgtgcagtttgcacttattgcagttttgcagaaatcctatgtcagcgcaaagtgcaaactgcaacaactgcaaactgcaaaaggtgtcgtttattgcagcttctcatattcacctcgctttactttcttgataaccttattcgtagcaaggctaaccaaagaatacattaccgacctttccgacaatcctacttcttttccggcttgaatggcatcggcagtagtgaaagttgcggaaaggcaatcaagcaattctcttttttgcggttcaacgctctctcgcaacatatatttctgaatgttggtataacagttctcaaagtattcactcaatgcaatagcagatttggttgagtcaatatccacaaaatccttgtgttcttcaccgcaagcccaacgaaggatttgcaagactaaagctaaacgagccgtaatcatgggagctttaatcactctgctatccaccaatccatcatcttggatttgattaacagcccgaactgcattattgcgccagtttgtaaaataggctttggcttccgaagaaaattccaatacattatgtatggctctgtcatcttcattctctataaatggcaaactaattaccttatttataatagaatcccacattgatgagtatttaccaaaagttgatacggaagattcttcatccagcccccaatctgaaatttcctgagacgatggataaacaaaaattattctgtctatcagcccattgtctttatatcctttctctatcagttcgtgcatacgtgtcgtttgcatcgtgccgacaatatttataaaaggatgctctatatgaataggtacagggatgctacatcttgaaatatccaatggttttccgctaaaggctgtcaatagctgctcaatgagttgtcctttgctatattgattcacggcattaaacattcccataatttcatccacatataccacgacacctcgctgattgtcatccaacgcacgcattaaagcttccggtgtaaaatcggatataatggttcttcgtaaaattggtttgtccggcaatgaagaggacttgtcttttttagccttattgttttcaaccaagctattataatgctccatatccaatttaaattgtttgatgattttggcatcatgctttcggataggacggaatgcaaaatccaaaggtggggttttgcccattccgggacgacctaccaatatcatataaagggcaggattactaatccatccaccacgaatacgaatattgacagcgttgccgatagcggttgacactgccaccaaaagagaagccatcatatattctatggaataattctcttgtcgggatagagccaatatcatatcttgaattttggcaggaaaagcatccaaaggaatcttgttttcaaagatcccttcaaattccattctgagcgcattgcataaattggttgaatccattagaatttggtatttctttttgactttatgaattgggcggcttcatcttccaagtttttatcagatttgattttgccggcatggagccattcgtcaatttccgattttagaaacatgatacgcttccctcttttgtggaatgggattagatgacaactcgtccagccatatacagtttgctctgccgggtgactgggaatataatcacacaattccttaaggttcatccattgttcggttggaacgctttgattctgattgtttaatccatctattttagaatccagctcattcaatttatccatcaaccacgacattgctttgggtaaatcttcaaatgtaatgttcttctcactcatattgctacttgttttttgatttttcggcaaaataacagcgattacgcatactgatttcatagtgtaatacatcacataaataagcagtaacgaaacataatcatcataaggattacccattgattatcaacatgaatagtggagaatatcagtagtagatttttatgataatgtcttcaatcataaaggaatcataagatggtcagaagaaaagaccatagataaaaacaaaaaagccacccacgcagattttacgcagatggctatacttttaaagtataataatggttattttgtttgagataaatccaatttaatagtttctgtagctttctctttcttttcatcaacaacctttgcatacacttgggtagttctcacattggtatgccctaacattttgctaactgtataaatatcagtacctccagccagttgcagggtcgcataggaatgacgaaagcaatgaaatgttatgtgtttggatattccggcagcttcaacccactttttgacaggacggtttatccaagaagggtcaggaagtccggcaaaaaccaaaagttcaccctctttttgctctccacagagattatatgcttgctctgatataggcatatattcaactccttttgtcttttgctgagtaaaattcaaccgatagcctccattgaacatttccacttccgaccacttcaacttctgaatgtcgcaatgacggattcctgttaaagcagagaacaaggcagcacgtttcagtaatgggtcacaaggtgtttgagccagtcggttcaattcctctaccgtgagatattctctccggctttccctttcttgaatgcctttgacttttgcagaaatatcaatagtcagatatccgtctataaaagcctgtttcaatccggctttgaagatagagaaataggttgctgctgtattttgagaaatcgtacctcgtttagtgcctccttgtggggcattcattatgaattgccggaacgattcaaccatctttaagtctatttgcgaaaagagaatggtgtcaccttttgcgaaaatcttcaataattcatgcactcttctccagttgacaatgatagaatcagagctatgggcatgccttgtttgctgcacatggtcgaagtactcaatgaaattacttcgggagcgttccaactgctccgcctgttctgcatcggtatcggcatataaagctgcattgtcgtattccttttgtcgtaggcttctgaccttgtcggcatagatacatgattcctggtctaattgcgacttacattgaatgacaccgttcaaatctcgcttcggcttataagtggttttgccttcggcattagtccttgcattgcgtgacttatcccaaataggtgttgtaatggtacgattgagatattcacgcactctttgtggcgtatcttttccggattgaaatacaggataagattccacataaagataccattcatcacgatattcagatttgcggagctttaccgacactcgtgtattgactaatgctttcttcatcgcttcacacctttatataagttatcaatttctttcttgggtacatacacaaagttcccaatctgccgggtagggatagagtatttgcgtatatggagataaacggtactttcattcacaagaaatttctctgtgatttctccaatggtataacagtcttttggctccagactatacagtttagcgataggcttcggctttgtgagagctttctttcggagaggatagagtttcatcagttcttcttttgataataatgtttgcctttctccggcattcacacttggaattgttcccttacgaatcaagcggtaaagagtttctttgcttatgccaaacaaagcgtatgcttcaggaacagtgatgtactttttggactttggtattttcttgaccacatcgtccaacctttgcaatctcaattcttcatccttgcgtcgtttccatgcaattttggaacatttgggagagcaataccacgattcaatggttttagccacaaaggtctctccacaaaccttgcattgacgtgttatttcaaattttgctgctggcataattcactttttacttatatttctcattctcaataccaacatttttataagtgtcacattatctacttttaagcgtcggtacaattatggtacaaatatacaataaaaatccgaataataagcaaaatcaaaaaaaagtgatataaaaagaaatagggcataacgcattgagttacaccctatattcttatttataattatcgttgtttactgatacttacttcacttcctcaaaatctgcatcctgaacattgtcaccatgcttgctattatcctgaccagcattctgacctgcatccatatcaggaccagcctgtgcaccaccctgagctccgccttgagcgtacatttcagcacttgcagtttggaaaacagtattgatttctgccatagctgtatcaatagcagctaaatcctgagacttatgagcatctttcagtttctgcaaagcagcttcaatcggagctttcttatcagcaggcaacttatcacccaattccttcaactgattttctgtctggaaaatcacgctgtcagcctgattcagtttatcgatcttttcacgttctttcttgtctgcttctgcattagcttcagcttcagccttcatcttttcgatttcttccttgctcaaaccgctggaagcttcgatacggattgcctgttctttacctgtagccttatccttagcagataccttcaagataccgtttgcatcgatatcgaatgtaacctcaatctgaggcacaccacgacgagccggagcgatacctgacaagttgaactgaccaattgacttattctgagcagccatcggacgttctccctgcaatacatgaatagtcacttcactctgattatcggcagcagtagagaaggtctcactcttacgagccggaattgttgtattagcatcaatcaatttcgtcatcacaccacccagtgtttcaatacccattgacaacggagtaacatccaacaataccacacctttgatttcgtctgtcaaaacagcaccctgtacagcagcaccaacagctactacttcatccgggttcacgcctttagaaggagtctttccgaagaaatcttctaccaatttctgtacggcagggatacgggaagaaccacctacaaggattacttcatcaatatcggagttgctcaaaccagcgtcgctcattgctttcttacatggttccagacaagcctgaatcaatccgtgagccaatgattcgaattttgcacgagtcaaagtcttcaccaagtgcttgggcacaccgtttaccggcataatgtacggcaagttgatttctgtgcttgttgaagaagaaagttcaatcttagccttttcagcagcttctttcagacgttgcaaagccattggatcctgagtcaaatcagcaccttcgtcgtttttgaattcctgtaccagccagttgatgattacctggtcgaagtcatcaccacccaagtgagtatcaccgttagtagaaagaacttcgaatacaccaccaccgaattcgaggatagagatatcaaaagtaccaccaccaaggtcgaatacagcaatcttcatatctttgtgagccttgtccagaccgtatgcaagagctgcagctgtcggttcgttaacaatacgttttacttccagacctgcaatctgtccggcttctttagtagcctgacgttgagagtcggagaaatatgcaggaacggtgataacagcttctgtaacttcttgtcccagataatcttcagcagtcttcttcatcttctgaagaatcattgcagatatttcttgcggagtgtacagacgaccgtcaatatctacacgcggagtgttgttgtcacctttcactactttataaggaacacgtgtaacctctttctgcacctgatcccagttttcacccataaaacgtttgatagagaagatcgtacgtgtcgggttagtaatagcctgacgtttagcaggatcacctactttacgttcgccgccatctacaaatgcaaccacagaaggagttgtacgcttaccttcactgtttgcaattactacaggttcgttgccctcaaatacggcaacacaagagtttgttgttcctaagtcaataccaataatttttcccatgatcgttattctttttatttattattattcaatttctttttgtccggttgttttctttctctttgtaagggctttcaaacggacgctgattaaaaaacaaaccatgtgccaaaaagaaatcggacgaatacgtgacatattttctgccaaaacgacagttttaaatcgaaatgactgctgtcaagtcacatagaagccagacagctatcgactcattaaacaaatggaaacagctctggttcaataaagcaaaagaatagatcataaaggaataaaaaatatgcctgtatcgttatgtgcgacacaggcatacctatttaatataatacgtatatcttacttttcaagtacaatcaccaacgcattatttgcgtcatacaaaccgattccaccaccggaaagtttatcgaacgacttcacttcattcattgctttcagaatcttaccttccacttccatatcagggcaagccatcattgtgctagccaccccagggaaagagattgatttagcattagtagtgctagtttcaaaaccaccattaatcaagttacatccggcattgccatgaagtgttttctttttcacatcaaaagcaatgaaaggttgcttttccattcccgaagtaattgcttcaccattcacttcctttattttccattctccgttcaatactgatagtttcacgtcagcctcctttttttcaagaactacaaccggacgattggactcattgcaaagaaacattttatccttaccggctttcttataacctttcacctgtgcaagcgcacctaacacatttctctcggtagtcatgtccggacacatcattctggtgctagccattcccttaagctccatgctgcctggcttggcattcacgtcaaagctacccatcatacggttacatccgctgttaccggatactcttccggtcgctgtatcaaaagtaataaagggaagggttctgctttcgcccggagttactttcgagccgttaacttctataatattccactcaccattgattgaagccaatgggactgccttctcaaccgaacggcatgaaaacattgcaagtactgtgctggcaatgcaaattgaaacgaatactttcttcattttgttataacgtttaagttaaaatcgggggcaaagatatcaaaaagattgggaaataccatctaatacgatataaaatacatacatttgccattatctataaaacaaacaataagattacatagttcatctaaagtaaataaatatgagaacaatcgtcctatttctaatcctgtttggttgtggttcctctcatatcacagcgcaaaatgattatcttgttactactatttccaatcaggaaggccctctaagtgaagaagaacagttcataaaagagaacttcccactgcaacttttatgtaaatggacacccggaatgaaattcatgtttattccatccggacgtgacatgttcctccctacccttttggtgtatgagacagaaaaaggggcagacaacagcgttctgaaacacaagattcttactttcgccggatatgaagaaaaatctcaagaactatcaaatgacatgagctattccactcgactcatcttcgaatgtgacggagaaaaatattattatgagattaaaaatacacgtccggatgaaatttgcgaaaagaatccccgtgcctatatcaacggattagttaatctgaaagacgtagacacggcaaaagaattgctgacaggcagaaagatatatgttcagtccgatatggcacgggtggacgacgccaatagttactccggatatcggaaagtgtctattccggtcaacaccgaagcaaccattaccgccataggagttggcagtcagtcatatcccgtgaaaatcatatttcaagattcgcagggacattcctattatctggaagtagctctttcccgcactaattccggtatggacgtgagcgatttccaagctgaaaagaaaatgagatattttcccaacgccatcagtttcagtagcaaaaagtccggaaatctggaaaccttgaaagacaaatatattgatctgaccgtctatccgaaacggacattggctgtaaaaagagtcttcagccttgaaaacaagcaaatggaaaaccgcatacatttgcctcgctacactgttttgaaaataaaagaaataaaaatctccggtccgggaagtctggttatcctctcactggaggattggcatggatcactttatgaaacagaggttgatttgaaatatgatgttatcgtcaaaaacgagaattatattgaagaccttttcggatttggagacatccatcagaagtatccggctatcacagataaacattgggcaatcatcgcacggggtgatttggaagaaggtatgaacaccgacgaatgtcgtctgtcaataggtgatcctgtagaaatacagttaaaaaaagacagtcgtttcgaaacttggttctacaacggaaaaacgctggaatttgagagtggcatcttgcaacgtttcaaataaaaaggagtagcgacgcggtgattatctgaaaataatcacgtatatttgccaagctaacaattctaaaatcttaatttttgatttataatttattaattaaaagaaatgggtagagttcttattatcggtgcaggcggtgttggtactgtcgtagcacacaaagtggcacaaaatgccgatgtattcacagacatcatgattgccagccgtacaaaggagaaatgcgataatatcgtcaaagctataggcaatcccaatataaaaaccgccaaagtggatgcggataatgtagatgaactggtagctttattcaatgactttaagccggaaatggtaatcaacgttgctcttccttatcaggatcttaccattatggaagcctgtctgaaggcgggtgtcaactacctggatacagccaactatgagccgaaagatgaagctcattttgaatacagctggcaatgggcttaccacgaccgtttcaaggaagcaggtctgactgccattcttggttgcggttttgatccgggagtcagtggaatctacacagcctatgcagccaaacattatttcgacgaaatccaatatctggatatcgtagactgtaatgcaggaaatcatcataaagcatttgccaccaactttaatccggaaatcaatatccgcgaaattactcagaacggacgttattacgagaatggtcaatgggtgacaaccggtccgctggaaatccacaaagatctgacttatcctaatattggtccacgtgattcctatcttctttatcatgaagaactagaatcgttggtcaagcatttcccgactatcaagcgtgcccgtttctggatgactttcggacaagaatatctgactcacttacgcgtgattcagaatatcggcatggcccgtatcgatgaagttgattataacggaactaaaatcgtaccattacaattcttgaaagcagtattgcctaacccacaggatttaggtgagaactatgaaggtgaaacctctatcggttgccgtatccgtggcatcaaagacggaaaagaacgtacttactatgtctacaacaactgcagccatcaggaagcttacaaggaaacaggtatgcagggagtcagctacaccaccggtgttccggctatgatcggtgccatgatgttcttcaaaggcgaatggcaacgtccgggtgtaaacaatgtagaagaatttaatccggatccgttcatggaacagctcaataagcagggactgccttggcatgaagtgtttgataaagacctagaactataatagaacgaatcagaatgaagaatataggagataaagcaccggaagtattaggcatcaatgaaaaaggtgaagagatccgactgagtgcttataaaggaaaaaagatagtactgtatttctatccgaaagacagtacatcggggtgcacggcacaggcatgcagtctgcgtgacaactattccgaactgcgcaaagccggttacgaagtaatcggtgtcagcgtagacagcgagaagtcgcaccaaaaattcatcgataagaataatcttccttttacactgatagccgatacggacaaaaagttggtagaagaatttggtgtatggggagagaaaaagttgtatggacgtgcctatatgggaaccttccgcactactttcctgatcaatgaagaaggaatcatagaacggattatcactcccaaagaagtgaaaaccaaagagcatgcctcacagattttaaatcaataaatccattaattataagaataaggtatggcaaagaaagacgaacttaattttgaaacagataataaaatggcatcaagcgaaaaactgaaagccttacaggctaccatggaaaagatagaaaagaacttcggtaaaggttctatcatgaaaatgggtgatgatagtgttgaacaagtggaagtgattcctaccggctccattgctttaaacgtggcacttggcgtaggaggatatcctaggggaagaatcatcgaaatctatggtccggaatcttccggtaaaacgactctggctattcacgccattgccgaagcacaaaaagccggtggtatcgccgcttttattgatgccgaacatgccttcgaccgtttttatgcagcgaaattaggcgtggatgtagacaatctctggatttctcaaccggacaacggagagcaggccttggaaatagccgaacagttaatccgttcttccgctattgatattattgttattgactccgtagcagcattaactccgaaagcagaaattgaaggcgacatgggtgacaataaggtaggtttgcaggcacgtctgatgtcacaggctttgcgtaaattgaccggtacagtcagcaaaacacgtacaacttgtatctttatcaaccagctccgtgaaaagattggcgtcatgttcggtaatccggaaacaacgacaggtggtaacgcattgaagttctatgcttctgtacgtatagatatccgtggcagccagccaatcaaagacggtgaagaagttcttggtaaactgactaaggtgaaagtggtgaagaacaaagtagcacctcctttccgcaaagcagaatttgatatcatgtttggtgaaggtatttctcactccggagaaatcatcgatttgggcgcagaactgggaatcatcaaaaagagcggttcatggtatagctacaatgacactaaactgggtcaaggacgtgatgcagccaaggtatgtatcaaagataatcccgaacttgctgaagaattagaaggattgatcttcgaagccttgaataaaaaataagttgtctcaaccgattcaactataaataatataagctgtctcattcgatgttttgagacagcttatttttagcttaaacataagaaatgtcccccatctgaatcctcgcagtacaattcagatgggggacatttctttcactttttacacgaaatagatataggctaatgtacttaaacttatgaccacccataacaaaacgccttggatcaaaggtttgacaccgacagatcttagaacatccaaagaaagggaagcacctataaaaaacatggtaatagtcaatgtcttgcgtgcaattccattgatggcggcacctaactgcggcacgccattcagcaaatatgtattcgcaatcatagctagaataaagaagaaaataaaccagggaatacttatcttctgacctttacttttaaatataaaagaagtggcgaatgccattggtatgatccaaagagcacgagtcaacttgatagttgtagcaaccttcagtgcttcttcaccataagcagcacctgctcccaccacagaactggtatcatgaatagcaatggcagcccatgtgccaaactgatgttcggtcatatccaaagcatgtccgatagccggaaagataaaaagcgcaatagcattcagaataaagatcgttcccaatgccacagacatttcactgtctttagctctcagcaccggccctattgccgcaatagcactaccaccacagatagcagttcccgaactaatcagataggaagtatttctgtctatcttgaagattttacgaccaataaaccagccgatgagcaacgtgcctaccacagaaataacagtaaactccatcccttctttaccggatgccaaagccgactgaagattcataccgaatcccaatcctactacagaatattgcagcaaatatttagatgtctttttattaaatttgggatgtgcctgtccgcaggttaatgcgaaaataagtccgagaaacaaagctaccggaggagtcacccatgcggaccatgcttgtaaaccaggaatataatctaaaaataagaaaaaagttaaagtagaaagtattgcaacgtaaactgtcttgttgttggtttgcaacgtttttgtagcgcttgaaatcatttttttatctttttataattttgcgggtgcaaaggtacggcaaacaatcaagacaacccaattgtttctaattatgtattataactttttgttatagccacttctcttattgttacattatgctcctacgatgtcctttccaaatggtgataatgctaacgcagccaacttaaagtgctgcaaaccaaagggtatcccaatgatggtgatacataggacagctccaaaaaccagatgtgacaaacaaatccaaataccacccaaaaatatccataaaacattcatcagtatataaaggcatccgcttgaacgcccaccactccttacttcttttccaaaaggccacaaagcaagtcctgccaacttcaatgtttgcataccgaaaggtatacctacaattgtaagcatcatcaatatacttgagattaaatactccactgccgtaaaaataccgccaagcaataaccataacaaattcattaaacagcccataagtatcagttctaatatttatttagtattttctttgttgtctcatccagcctgccttgaaaatacagatcaattaccttttgaaataaatcatcagaagcaacttcattaaaaagtgtcatacacgacagcactttcattgcgtccaatcctccgaatacatctaccgcagtcttacctttcagttgcaaaaatactgttgttatttcacggagtctcactcccaaaatgggatgagcaagatatgcttcggcctcctctttaccacaaattccataatactgagaattatagctcattcccagtccttttaactgaggaaatatgtaccaaatccaatgagaatattttttcccatttttcacttctgcaagtgcttggttataaacaccttgctgggcatctagaaaacgctgtaatttataatctaccatatatatcttctcataccacattcttgatgtatacaaagatatgtgtattttgcatataattgatagattattctaaaaaagaacacgaatcaatcctttagcaatctaaagatatctttggattactaaaggattaatggaagaaatgtaattctgaaataaaaattactctttaacaggtctaattgccattttaatcatacttgcattccaactagcattataataataacttgtagaattataatagaaaacatagccaaaacgtccataagtatcaccgtaagattctccaacccaataataaccactattctcgtccactagctgtgtagctcctgccggtccacttgccggaagcatataacccgtagagggtaaaaagatgctatttccgttactacctgttactttcataccactgactccgtttattgttgctcttgtccatgtacatttcttaatcaaatctatttgctcagccttattgggcaatctccatgagcctccccacattgcacgtgctatgtcatatttgcttccacagatattatcaatattaggagcctgataatcaggcataactcctacattatcaacatctccccatagaaaatagccacctttctccgaagatgttattgctcccaaattaaatgaagcccacctcacactaagtcctaaatttacagctttataaagtgattgttctcccaaaggaataactatttctgttccatctttgagtattaatctgagttcatcttccgttgcctctacagattcaaaaaatgaatcaccatccattccagaagttttaactgccttcccgtattcgtcaagcaatttggaataagtataacctttatcatagcttatgatccaatatccatcagagtctactttcaatagtggcgtgatagcatccgttcctgatgcaggaatcttgtttccatcactatcattaagccatgttgtttcaccattaatagtttgtacccaatagtatctaccgttataataacggacattgattacgggagcatcttttccattaatcccatcttttccatctgaaaccgtgatatgcgaaccatctgaaaatgtgagtgtatagccatctcccaatgtagtaacattggttagatataacctattttgaagtgcccctactaaagcactaatcgatgtgatatcattattcaatgctttcaattggttctcaatagaggtcactctgtcatctaaagaattaactctatcccataattcgctgtcatcgtattcgttacacgcagttgtgcacattaataacagcacaaactgataaataaatctaaatgttttcatttttttatttttaatccaaacttagaatcgaagatttcgactatctgatttttatgagtatattttatctattatccaaatacttatttgccgttttagtctattgtgcagcaatacttaccttaaaatatccatcagggaaattctgtatgtaatccccactaaagtagaactgcacatatgctacatctcctgagccaacatatctcaacataggatcataaatttgaccagttcctgtaagtgataatgttccactaccggtaagcttataatttgaatcatacacctcataacgcaatcgcttgctatagtttacatcattaaaactaccaagatactctaaatttatatgcatataggtggatttcctattgaacttgaacacatccacatctctagtagaagacaatgagaatttcattgactgcccatccttgatggtgtttgcgttagagaaattattgttatactcactctctatatattctggtattacatttacatagactctctcatttccgctacttaaacgtgttatgtatcctgttggtttaattccaactatacctgttttcaatcctgtagcagtcccatctgcatcaatagaaattactgatggttcagaaacaacatttacaggttcatagaatacaaaatcactcagattgccaaaaatattcaacacagaactaccttgcttagaagtatagctgattttctgagattctcctacggccaaagttaacataggataaatagagtaagtctcacctgtattactccaagagaaatcagatattcgagaatgaacagtatattctttagatactccactatttttatctttaacaacaacatttgcttctccataacctacaattttaacagttgcattgccaccactaccactgactgtcaagactctgatatcagaagaactccattcataatccgttacagcatcacttggtttacaagtgacaaaaaagttataactatcacctacataagcatataatgttccattgaacagtatatcaagagcagtaactttcactaccgttgcctgtatgacggttactgtttccgtcttctttccatccgaagaagtaaaagttatcttgccagtacggctcttacctgtcgtattggacattatattaaatttcttcatactgtttgatatagagcgtgtaggtatttctgtaatccaatcattagaaattgacacaccatagtcgatattactcttcagttgaacgttaatgcttgtagtattcccatcaatattataagaagactgagtaagtacaagaattgcgccaccactctgataaaccttcagagtatcactgatgtcgttgtatttgaaatagatttcaccttcacgcttatcatattcatcactgcttgctacagaaaatgcagatgttgtttttgataatccacgatgaacattaactgaagagttagccctactaatccagctgttgcatgaaggaggaatttcaatagagtactcaacattactattaacatcaacaaaaaatgttccaccattttgggggacttcaaccttgttgtttgaaagcagtatagcatccttctgattttgcttaatggaaacactttctttcttgtttccgttggcatctttgaatactataacagcctcacggtcagcatatgtgttatttgcacttatctcatagacaagagtatggcttgaaactgcacgagataaatttgcagattgaatccaatcaacattaggcatatctatttcatattcaaagttgctgctgatgtcaattgatgcccgtccaccatcacagccaaaagtatattcattttgagaaagaataagaatagcagaacccgtctgatacacctttactgtttcatccgattcgccggaagtgataatgatttctccttcacgtttatcatattcttcacttggggatattgcaaaagaataaaagctagtagacaagccacgtgtacgttcagaaataactggttcaatccaagtcctgctattttcagcaacagtcacattataatcaatatttgactttacctgtaaattaataattcccccatctttatcaacctcaaatcgattcgatgtcaatgttaaagcatctttttgtttctgattgatcatgatgcttttagttaattcatcaacactgagctttaaaacaacattcctgtcatcatatccagtattactagccaccacaatagttaatgtgacatttccagctttaccactcgaaggagacactgtacaccaattatccccattctgcgtctcggcaagggaaactgaccagtccttgttagtggaaaaagaaattgtagcccgttcaccttctgatgagacattgattccttgactaaaaattgtctcacattcagatgtaggtacgatttctgtttctactctaacttcattcttttcgttctcttcaccgcatgaaaacaaaaagacaagacataaacacattaataataatgttattcgactaattttaaatttacggttcatattatattactttaaaataaactctgctgatgagattccatatctttctccagtttctgataataaatctcattaatagaatcaaatcctaaacgcaatccaactaagtatactgctagtttgtactccttttcatatagcctcttaaaactatttctacaataatctttcattaatgattgataatttggcaatgaaaacaaatttaataagtaaaaataaataggtatcaaaatatattgtcgtatacctttccgtgtacatttctcaatatatctctctgcacatttattgttctttaattcacatactatatattcaaaatcatatctactctgtcgatcaattagattcaaaacttttaaaatctctgttttcggcatagtaagatattcttttttaaaagtatagttaacaaaaacatgaaccgaatcataaaaatatcctaggcaattactgggatatggctcgtgacgttcatacattaataaatattgccaaattgagctattctcatccaaattttctttttgaaatcgataatttgtgaccttaataatcaaatcctcatcatctaaatcctttaaaggtttttctactttaatacccaaaatctctaaacaagcagatgcacctttgcacatattttcactaaataaagactgagagaaatcatctacataagtcccccacaatggttctacaaactttatcattttattaaagctcatttccatatcttttttagcaactaaatctaatggaataatcgattgtacttctttatattcaatattattcttgcaatctcttttaagccatttcctctcacgaagaaatttaataaaaacatattcacttgtataatcaaaaggagatacattcttcaacagctcccttatatattcttccggtacactatcattgccggatatagttttcacgtgaatagtgcataacacaatatatcctttcttaaacagaatatttaaatcattacgatgtataatgcccaagtattcatatctcattttagccataatcaaaaatctatatttatatcatccgacaaattgggatgcaattcattacttatcgaaatatttgcacatatagtgctatctgaactaaataaagaaacataacttaaaggcatgcctgtataagtgatgtatagattatttctgctccggctcattgcaaccataaacaatttctgagtaatattactatctccaggaatatataagtctgtatttgcaaatggaataaaaacattatcaaaatccaatccttttacaccatgataagtcataataacaatacgtttatcgttttccgcagctaataacgatccataactatttacaacgcattctataggaacttgattttcctttagatgatcattaagccgtttaaaataaggttcataatattgatcaatccatttttcccatacaggtttatgttctaactgcaaaacggtatcacaaaattccaatactttatctttagtaggaaataatattgcacaactctgattacgattaacaaacttacgtgcctccctcattatatattcgacttcttgatccacaaattctgctttgcataagcgtatttgcgtatctcttttaagcatatacctctttgcactaaaaatattcatcgatggtatcattttctgaattgcagtgattatagaacgagttaacctatatacgtataaaagtccccaatcttcagaatcaattaattgagtaattttctcaggaataactacagcttcttgatattgagggtcctttgaataaatagattggttactatctcccgctacaatcagcatataccttgtctgatctttcatctttatcaaaatacgagatgttaaatcttgaacctcatcacaaaaaatataatcatattttctctttgtttttaagaattcatacatcgtgacaattttcacatttgttatattcaactctgcaagttcagctttgcaaagttctatcaacgaatgagtaaacaccactaataatatttttgcattttgagtagcctcattattcaataagtatttaatggcatatacaagcaacaccgattttccgcttcccggaaacccttttatccaaatattctgaccaacataatgattatctttcagtttctttagaaaatccttttgttgagtatccaaactttcttctgtaggtattctagtactcataattagtctcctttcaccgctactgtattattagaattataaaaatcatccaatgatatcctttttgccttttttctgacctcttcagcaaaaatagactcacctaattcctctgcagcacttggtaaccaagtataatctacatcactgagggtaccattatcatattgagccttccatatattataagctttctttatcttttctactccttctattttctttccttcttttttttcatactttccaagttcaaataaaggatgtggcttattcgggcacattgctaaagattcgtgaatatattttaagaacattgaagtatcaatatttttatagcgataacccaaattaaaagcagaaaccgcatccttactatattcataagctttttctccgtaacgtagtgctttcctattatttcctgcagaagaaaagcagcatcctaatttattataactaatagtaccaggatataattcattacattcctcataagtttcagctgccttcaaatttagagttgcgttttcgtaagcttttgccaattccaacaaacattcttttgatggtactcctctattattagctgttgtattataagcttttttctctgctctcaatgctatcctctcctgtgaagttaactctttatttgcaaaaggattaattgcacttactaaacaagtttcacttccaaccttggcattaattgtcagtaatttatctgcagttaattctaattgcagcttaataggcgtatccaaagaaaatccattttgttcatttgaagttataaccaaattagtcaatattttattctcattactgatacaaatagggaattctacagttttttggccttcttttacaatagcaagattatctatttcaatagtatccgtcggcatgacagttccggcaggaaccaaagtcattagctgatcattcttagtaattatacatattggttcactggttattggctgtactatattctgtccaaaagagttatagatgaacgaatgaattgatgcacctttagacacacaagtctgaagatcaggaaataacaataatttggaatatggcaaccatgatttcagagcggcttgtacataaggattaagactactcccacccaccaataaaacataatcaacatcatctacttctaatctagccttacgaatagaagtttttacacaatcataaatactattatatatttgtttttctttttgaataacatcgcttttcttccttgtgaaaactttcataagttctgcgaattggatagatgttaaaaaaatctcatccatgtacaatacccctttggatgtattaattcgaatatcctttacagaaactttatattcttgttcaagacctgacaaatcgaaactatccctcattagacttatggctttacatatccttatttttaagttttccgcagtagtcaaaagagcatttatgatttttttcttctcagacataataaagatatccatatctaaatggttgtgagacaaaagttcagggtacaatatctcataagcaatgtatctatcaatatcatttcctcccaatttttcaaatttagatattgacaaatttttagaatatactcccttataatctacacctatttctaatattgaaatatcacatgtcccagctccgaaatcaaaaactaacattttaggattaatatctttaggaattaccactgcttcattattcatctccgattcatgaatatagtttaaaaaagctgcgttaggctcatcaatcaaggactgtttgctaacatccatttgattgcttattaaagcatcaaccaaatcgcgtcgttgattcgcctcgaacgaagcaggaatacttactgcatatttaatattctgacatagtcctttttgttcgacataggattctatctctttctttaagaatctgaaaaataaaatagtagcatcctttgcattttggattcggacagatttatctttacccaaaatactattacaatattttgcacctaaatcttctcctaactccatcttaaaagagtaccagacatccttgtttttttctaattcatactttaagtttgcagctccctctccgacaagtacccgattatgataaagagctataactgtaggcactttttctccagtaaagtccgcaccatcactttgcttctgtcgtagattcattacttcagttacaactattctcttttcattatcaaaatatgaataagaaactactgtagttgatgttccaaaatcaattcccacgtaagtagcttgttccttatgaattgtgctcaaatccgcagttacaagattctccactgtcaataaaataggcataatctctaaatgttaaaataacaacgtttttgtgtgtgtttagaaattagtgaataattatatattcatattaaaagtaataatgtttatcagtattagtctattatactccaatctatctttatatatattttaccaaaccattcattagaaaaattaaatgaaagatacttctaaagaaaagtaataaaacatattgcatatatacttttttagtattactaatatgttgtttataatcttctctaatattagagttactgaagcaggattgctgatatacaaataacacgcacaaggaatttcctaaaatctacgattacactttccataatttactcaaaataaccagcagattcccgaaccggacggttcattaattagataagtaatactataaaagaaaaagcgcgggaatctgtacctgttactcgtcccgctgtttgaggccttcgaactgcccgtagtagtctgaacgagcaacgcagaagcccacgccgatatgtataacaatccacgtatacttttatttcaaagtacactcaagggtataaacatatcccgtagacatctactgttgctttgttttgactactgcttaaagtgttcgaagtttcaaacagccaaagacaaaacgtcaagtaaacgtctttctttatataatatatctcccacaccaccctaacctcacgaattgaggtatcggcgtgagagacaatgcaaaactataaaaataaaattaaatatcctacttcatgccattctttttccaaaaacacacatatcttgggcaaaagcaatccaaactcatttaaatattacctcctattacttattccccaatctattaacaaataaattattctttattagtagtaaacttgcttttatcaagaagataagttacctttgtttaatagtaaactataaatgcaaattccaattatacaaatgcaagttgcaactttaaaaacgcaacttgcatttataaaaacaaaagcatcaattatagtttataattaaccaataagaactttagtattggaagaaaggaactttacctctaataccaaagaatttatctattaatactttagaaccaagacagtatggcacgatacattatggaagagatgcccgacattcagaaaacgggcaaaagaattacttatcccaagtttgcacggatagacaatgcaagcattaaggaactggcgcaacgagtaggagacgtcagcggcttcagtgccggagacatagaaggcgtattgctccagaccgccatagaaatggcgcatctgatggcggaaggacgctctgtgaaaatagacggaatagggacttttaccccctcactcgccctatgcagagacaaagaacgagaagaggcggaagaaggcgccaaacaccgaaacgcacaaagcatctgtgtaggaggagtgaattttcgggcagacagaacgatgatcagaaacattaatgaaagatgccggctggaaagagctccatggaaaccacaacgctcctctaaaaagttcacaccggagcaacggctgacattagccctgaaatttctcgacgaacacgctttcctgactgtacggaattaccaaagactaaccggactgcttcagacagctgctactaaagagctgaaacaatgggctgatcttccggaatccggtattgatattgcaggaagaggttcgcacagagtctatgtaaagaagaaagttgccactgaataaaaaataatatatgatgagagataccctgaaaatagatgagagataactaaaaatgaatgagagataactgtttttaggcgtattttcactataaaatgatgagagataggttcttgcagaagtatctctcattcgataagaatcttattatctgatatttaagaaaaaacaatgagagcaatgagagataaaatctttttttctttttctgtagaaggtaagattcgaatgaaaaagcagcgattatgaccgaattggaaaataaacgcacaaaaatggaataatcatcttaaaagaactatctttgatatttgattgtttgaggagctagaatctgaaaaacaaaaagaagcaaactttatagttatggaaacagtgaaacaaataccatatggcatgtccaactttgaggacgtaatcatgcaaaaccgctattacgtggataaaacaatgtatattcccttattggaagatcaagccaactacctgatcttcattcgtcctcgacgtttcggcaagagtctgctgcttagtatgctccggtcatactatgacctttcacaaaaagataagttccagcaactattcggcaatctctggatcggtcagcatacaactccgcttcaaggcaaataccaaatactttatcttgacttttccaaaatcggtggcagtattgatgaactgccacaaagattcgattcttacagcgctgtgcagctagacggttttctcaaccgatatcgtgaatattacacagatgaattcatagaacgtttcagtgctgcggataaaggaattgataaacttcacatccttgatgacgaagccaggagattaggttatcccctatatcttattatagatgaatacgataacttcaccaatgtcgtcctcaacgaaaaaggcaacgaaatatatcgtgccatcacccacgcaagcggcttctaccgtgatgccttcaaaaactataaaggaatgttcgaccgtatctttatgatcggtgtcagtcccgtaacgctagacgacttgtcgagcggttataatatcggttggaacatcagtaccagtccggtatttaaccagatgctgggattttctgaaaaagatgtgcgcactatgttccaatattacaaggaaacagggcaactgcatggagatattgaagagatgattctggaaatgaagccgtggtatgacaattattgttttgcacgtcaaagcctgagttctgatcccaaaatgttcaactgcgatatggtactttactaccttcggaatcggattcagttgggagcatctcccgaacagatgattgaccctaatacccgaacggattataacaagatgaaaaaactcatccaactggatcgtcttgacggtaatcgcaaaggcgttatcaaacgcattgccgaagaaggaaaaatcatcactaacctattccagtctttttccgcagaccagattacgaatccggaaatatttcccagcctgcttttttactatggcatgctgactatcatcggaacacgtggaaatctgactatcttaggaatccctaatacaaatgtccgaaaacaatattatgaatatatcttggaagaatatcaaaaccaccactatatcaatctgatagatatagagatactcttcaataacatggcttttgacggtgaatggcgacctgcattggaatttatagccaaagcttataaagagaattcttccgtgcgcagcagcattgaaggagaacgcaatattcaaggattcttcactgcctatcttagcgtcaatgcatattacttgacgacacctgaggtagagttgaaccatggcttttgcgacatgtttctcatgcctgacctgcaacgctatgcagaaattgcacacagctatatagtagaactaaaatatctgcctaaagaaaagtttgatgcccagtctgccgaacaatgggaagaagcggtggctcaaattcatggttatgccgcaagtccgaaagtccgtctattatgccaaggcacgcaacttcactgcatcgtaatacagttctgcggttgggagatggttcgtatggaagaagtctgacctacaagttcttgctatgatgccccgcaaagcgcataaaaacttgagataatcctccctcctgcccttgtagctgcacaaaattaaattcgcgcaacattggcatcccttttatctcaactacccgtaaagtgccggccacaagttctttatgcaccgaccggatagaaacaattcccatacaatcagtatgttccaaaaagagcttgatactctccgtaccaccaagatacatcagaacattcaaagaagacagcttcagattgtgttgcgacagggctcgttcaaatacatccaacgtccccgaacctctttcacgcaaaaccaaagggatattcggcaattctgcaggtgttatctcctcctgaatatttagtttactgttcacatgcactaccgcaacaagttcatcttgcaaaaacaaagtatatttcagattaggtaaacgaaaaataccttccaccaatcccaattcaatccggtgttcttgcaaagcgacctccactccccgagagtttccattaaggacggaaagattgacttgtggaaacttcgcaataaaatgagccaataaagggggcagaacatattgagcaatcgtcgtgctagctcccagtttcaactctccaatatactcgttatgcaacaaatgcatttcatattcaagccgcttgtaatcatctaaaatcttttcgctatgcttcagtagtaattcaccggcaacagtcaatgagattttactcccctgacgttcgaacaaacgagcctgataataagtctccaattcctgaatatgcttagtgatagcaggctggctgacaaacaattcttgcgaagcctttgtgaaactcagattcttcgctacgctctgaaatacttttaaacgaaaatcggacacctttttatttaagttatttgaggattaaaattaaagatcaggaattaaacacaaagactatagttcttcagctttgattcctaatgcttgcataatagggaatgccaacatatcccacttatattctacctgcacttcaggctcattcatacgaaactggataatctccttgcctttcacttcatgcaacgcatcgaatactttctttccatattcttcattgaaagaaacgacaatcatccttttcacatcagccgaatcagcaacgatagacaataaatccaaaaacaaatcttcgcgtgaaaccatcccttccgaaggaacacttgcaaacgaatattcaccataaggactctgaaaagcgactccattcaactccttcaccaaatcggaaggatggcaatgtacaagctgatcggactccttatcgtaaacaaaaagaaattgtacttcatttttcccttccgtgattccggcatccaaagtcagataagtggtcaacatagaaaggtcgatatcctgtaaagaacgtcgcaaagtctcttcaaagtaacctttcatatctgtaattacaaaattcaagaaagcagcatcaatcaacactactgtttcagacagttttatttgaggtttatcattcataccttatttataatatgattacagcggataaagatactacaatacttttatttattcacttcatttcgcggcaaattcgtcagtatcattcagatgaaaaaggtcattttgtcttctaactcctttataatcatgttattttgtcatatttttctacttggcaaatcttttgagccccttcaagtgttattaaaatcatgaaaaaagaaaggagaacaaccatatgaactttaacaattttaccatcaaatctcaagaagcggtacaggaggccgtaaatctcgtacaaagtcggggacaacaggcgattgaacctgctcatatcctacatggagtaatgaaggtaggcgaaaatgtgactaacttcatctttcaaaaattaggaatgaacgggcaacaggtagctctagtcgttgacaaacagatcgaatctctgcctaaagtatccggaggagaaccttacctaagcagagaatctaatgaagtattgcagaaggcaacccagtattctaaagaaatgggagatgaatttgtttcattagaacatattctactggctttgctaactgtgaaaagtaccgtatccaccatcttgaaagatgccggaatgacggaaaaagaattgcgtaacgctatcaatgaactcagaaaaggagaaaaagttacttctcaatccagtgaagacaactatcagtcattggagaaatacgctatcaatctgaacgaagccgcccgcagcggcaaactggaccctgtaatcggacgtgacgaagaaatccgacgggtactgcaaatattaagccgccgaaccaagaacaatccgatcttgattggtgaaccgggtacaggtaagacagctatcgtagaaggattggcgcatcgtatcctccggggagacgtacccgaaaacctgaaaaacaaacaggtctactctctcgatatgggagcattggttgcaggagcaaaatataaaggagaattcgaagagcgactaaaatcagtagtcaatgaggttaagaaatcagaaggtgatataatcttgtttattgatgagattcatacactggtaggcgccggcaaaggcgaaggagcaatggatgctgcaaatattctgaaaccggcattggcacgtggagaactacgttcgatcggtgcaaccactctcgacgaatatcagaagtatttcgagaaagataaagcattggaacgtcgtttccagattgtacaggtagatgaaccggatactctgagtaccatttccatccttcgtggattgaaagaacgctacgagaaccatcatcatgtacgtatcaaagacgatgccatcatagcagctgtagaactgagcagccgttacatcactgaccgtttcttgccggacaaagcaatcgacctgatggatgaagcagcagccaaactacgtatggaagtagattccgttccagaagaattggatgaaatctcacgtaagatcaaacagttagaaatcgaacgtgaagccattaagcgtgaaaatgataagccgaaactggaaattatcggcaaagaactggccgaactaaaagaagttgagaagtccttcaaagctaaatggcaaagtgaaaaaacgctgatggataaaatccagcaaaacaaagtggaaatagagaatctgaagttcgaggcagagaaagcggaacgtgaaggagactatggaaaagttgccgaaatccgttacggaaagctccaggctttggacaaagagatagaagatacgcaggagaaacttcgtggtatgcaaggtgataaagccatgatcaaagaagaagtggatgctgaagacatcgctgacgttgtttcacgctggacgggcatccctgtcagcaaaatgatgcaaagtgagaaagataaattattgcatttggaagacgaactccatcaacgagtgattggacaggacgaagcaattgaagcggttgcagatgccgtacgtcgtagccgtgccggattacaggatcccaaacgcccgatcggttcttttattttccttggaacgaccggtgtcggtaaaactgaactggcaaaggcattggcggaattcctctttgacgatgaatcgatgatgacacgtatagatatgagcgagtatcaagaaaagcatagtgtttctcgtttggtcggagcacctccgggatacgttggatacgatgaaggcggccagctgacagaagccattcgccggaaaccttactcagttgttttgtttgacgaaatagaaaaagcgcatccggatgttttcaatatcctgttgcaagtactggatgacggacgactcactgacaacaaaggaagagtagtcaacttcaaaaacaccatcatcatcatgacttcaaatatgggaagttcttatatacaaagtcagatggagaaactgagcggttcaaataaggaagaagttatcgaagaaacgaagaaggaagtgatgaatatgctaaagaaaaacattcgtccggaattcctgaatcgtattgatgaaacaatcatgttcctgccgctgacggaaactgaaatcagacaaattgtactcttacaaatcaaaggtgtacaaaagatgcttgcagaaaacggagttgaactggaaatgacagatgctgctttgaatttcttatcccaggtaggatatgatcctgaatttggagcccgtccggtaaaaagagctatccagcgttatttactgaacgatctgtcgaaaaagttattgtctcaggaagtcgacagaagcaaagcaatcattgttgactcaaacggagacggattagtattcagaaactaaattatagttagttgttataaggacagccggtatgttcccaagtgagcatatcggcttttttatattcctgaatatataattcttcttacttccggctgacaattaggatggctcatgactaagacataagtaccttttctggatatctccaaagtgagtgaaggcaaggcaaatctatgtttctctttcagctccccctgcgaatcatataaaaataccattgtacctaccaacattcctgttaagcacaatgttcctttttcattatcaagataaacgtttacctctttatttgttattacatccatattttgtgcgtatattagcagtcacaaagatagagaaaaactatgtttatttactatataaataataaaatattcatgcaaacataagattgcttaaagaacactaaaggggatcctttaattacgcagacatataaaaacacaaaaaagcgtgacaacttgcaacattgtcacgctttccttattacatttatacatctaagccatcaatgtttcatgacttatttttcatcagtcgcaacctcttcttcagcttccggctctgatttaaattctgtaattccattcgaaattaagatgttataccaggaaatcaatttcttaatatccgcaacgtatactctttcacgatcaaagttaggcaatacctcccctaaatactcgcgtaactgctccggagtagcttttttagggtcaatggaggtgactgcagtattttcttttttcttcatagcttccagcacatcatacaaaggtacttcagcatcatctgtatacattgctatatctgccaaagagataattttctcattaccataagcggggaaacgttttttatctgcactgattgattcaacaatcaacatattttttccttgcgaaattagtttgtacaatcccggtttaccggagatagacaggatagtcttcaacatagtatatattcttttatttattaattatttttttgcggagcaaaggtaatgattatttttagatagcaaagaaataaacttcaaaacctgcggaattaaaggggtttcatcgtcattcacgattacaaaatcagcatgattccgcttaacctcatcgctcatttgcgcttcgatacgtttcattatcaattcccttgaagaatagtcacgcctaattgcccgttccactctcacctccaacggtgcatataccattactacaaagtctacttcctgcttaaagcctgcttccagaaggatggcagattccataccgaccatagctatatcacctttccctttcacccatcgcctgaagtcttctttcacctgcggatgaatgacagcattcacttttttcgcatgttcggggcttccaaatatataagatgctaataaaggacgattcaattctccattcaggaaaacatcctgtccgaccaaggcgcaaagttcccggcgtatcacatcattcgtatgagtgatacgcttcgcctcaatatcggaaatataaacggggattcccataatctccagcaatctggaaactacactttttccactaccgataccgccggtaatacctattttaatagccatcggaagaaacttgttctatcagaaaatcaacttgctcgggtacaatacggatttgattgattccacggggagccgacttcaacttcaccgtatatttatccgatcctaattttagcagttcctcataagaaacattaatcacaaaatcactggctttaatgctacgaaaacgctttaaacccacttgaaaagtaatttgaaccttcgatggaaaagcacggagcactttatctgccgggaagttaatcccacgtaacggcacctccacggttttctcagtataaatatcaacagggaaagtcagttcaaccgaggcgggaacaaacttcactccttttttattatccaaggcaacccgttgccgaatcgtatccgatatattttcaagatttacctcttgagtataagcggttgttatagtatccaaaattccggccggagcatataccaatacggaatccggactgcaaatggtatcagaaacataatattgaagccctgcagtcacttttccttgaaaatgaacgggtactaatttggacttgcctgtcgaatagatataatctaacgtatcaggttttattgaaagtatcttagaagaagcattcaattgactgagtatcttcttttcaaactcagaggcaaagattttcacgtgattattttgccctttatagtcagggaaactcagatttaccggaaagaaactcttccccaacatataattgagaagcactgttcctttatcttttacccggacgcgaagttcggaaggaggttccgaagtgagcacaatattattagggacatccttcatcctcaccgggatagagaattccgcttcatagtcattattaagagtctgaatcagccagaatccactggctatcaggaaaaaaaataaaaaaattaagaactccctgcttttatcactaagcaggaaatccttaattctcttggatagtcttaaatatgtatatcttaatttcctacgatcaagcatagggtatttgtttactaaagattatttagactgattgccggcagccgaagcatcagcaaaaatagaattcttatctattttaatcttcacgttagaagcgatttcaagtactatataatcatcagtaatctctttgattgtaccatggataccacctgcagtaattaccgactggtttacctgaagagatttacggaaattagcaatttctttctgcttcttattttgagggcgaatcataaagaaatacatgataacaaacatagctatcagcatgatccacatcatacttccacctcccgctgcgggagcttgcaataatacagtcaataagttcataaataatcaagttttagtttctactatatggacaaaggtatcagtttttagtcaacttaccttcttttttcaattgattaactattccatccagcgttccgttgataaagctaccgctcttggcagtgctatacaacttcgcaatttctacatattcatttaacgaaacacttaccggaatgttcgggaaacttaaaatttcggctaaagcagtctgcataatgataatatccataaatgcgatacggtccaaatcccagttcttcgtgttctcgctcacaagatgacggtaatagtcagcattcagaattgtacgacggaacaagcggcgtgcaaattcctgatcttcgtcatccttgaattcgggaagtaattcctgatttgctccgttcttttcttcaaaacgcttaatcgttttcaagacaaaggtatctacaatctctttatcgtcattccaatacagactctggtcttccagcacctgatcaagagaatcattattaaagatatatgttttatagagttttctccacaattcgcggtcagcttcatatgaattgtcaccggaagccatataatctttataaatatcgctttctactattttctcataaagctctttgacgaaatcctgatcatttgcccaagttctcttctgattagatataaactcggtcagttgcttgttcacctccaactgtgcaacaaacttattatccacaaactttgtgttgggatacaactcttctttagtaggagccagttttgcttttgccgcatcaatgcgtttttgtgcatactctgttaatgccatcatcagcattaacaaataattataaaggtcatacgcctttgaaaggctgaagaataactctttctccgctgagtctagatttttgctgccattttggtaataggcatacactatttgtataatcttaagacgaataagaactctgttgatcataattcaaattaatactgttattatcgaactgcaaaagtagatatttttaatgagtttccacaaataaatcacattttttaatgcagtatttgattctctgcgctttttcttttgacagtttaaaaaaaatatccaattttgaggccgattattaacggacccaatgatatggaagattttaaaaagaaaatgaacgcagacatgaatgataaggagatcgttttctccaagtccatcaaagcaggtaaacgcatctattacctcgatgtgaagaagaaccgtaaagatgaaatgtttttagctattacggagagtaagaaagtggtgatgggagaaggagatgactctcaggttagcttcgaaaagcataaaatcttcttatataaggaggattttcagaaatttatggcaggattgacagaagccatcagttttattaaccacagtgacatgaacgattacatcagccgcctgaacgaagaagctgatataaaaagagaacaggaagctcttgccgaacaagcacaagaggacaagctggaaaacgaaattaagattgatattgacttttaaagaggtaactctttgatatttcaaaaaaaaacagtacttttgcaccgcttttttgcaacatcatgtgataatccacatcgtgtaatggtgaattaagcaaaataacttaatttagagtaacacaattttttaagaaatgaaatcaattgaagtaaaaggaactgcaagaactattgcagaacgctcttcggaacaagcaagagctttgaaagaaattcgtaagaacggtggtgtgccttgtgtactttacggagctggtgaagttgttcactttacagtgactaacgaaggtcttcgtaacttggtatatactccgcacatttacgtagtagatctggatatcgatggcaaaaaagtaaacgctatcctgaaagatattcaattccacccggtaaaagacaacattcttcatgttgacttctatcagattgacgaagctaaacctatcgttatggaagttccggtacagttggaaggtcttgcagaaggtgtgaaagccggtggtaagcttgcattgcagatgcgtaagatcaaagtgaaagctctgtacaatgtaattcctgaaaaactgactgttaacgtttctcacctgggattgggtaagactgttaaagttggcgaactgagcttcgaaggtcttgaactgattagcgctaaggaagcagttgtatgtgctgttaagttgactcgtgcagcaagaggtgcagcagcagccgctggaaagtaatttgagattatccctgtaaagagatatagcaaaacgcagattaatgcagattaaagcagatgttcagtctgcattagtttgcgttaatttgcgtttttctttttatattcacgaactgttttttacgaaaaaacaatgatcaaatatctaattgtcggactaggaaacattggacccgaatatcatgaaacccggcataatattggtttcatgacagtagaggcattggcaagaatcaacaatgctcctccctttattgacggacgctacggatttaccactagtttttcgatcaaaggacgccagttaatcctgctcaaaccgtcaactttcatgaacctgagcggactggccgttcgctactggatgcaaaaagaaaacatccctttggaaaatgtgttaatagtagtagacgatctggctctccccttcggcactctgcgtctgaaaggaaaaggaagtgatgccggacataatggtctgaagcacatagcagccattttaggaactcagaactatgcccgtttacgctttggtatcggaaatgacttccccaaaggcggacagattgattatgtactcggacactttactgacgaagatcgcaagacaatggatgaaagactggaaacagccggagaaatcattaaaagtttctgtctggcaggtattgatattaccatgaaccagttcaataagaaataggagtatgtacaattgactatttcacagcgtatatatgcaaacggtcattaagtactccaccatgacacatggtacactgttaattaataaattatcaatatatggcagaagcaagaatagataaatggatgtgggctgttcgtattttcaagacacgcacaattgccgccgaagcctgcaagatgaaccgtgtcactatcaacggagcatacgtaaaggcatctcgcatgataaagccgggtgatgtagttcaagttaagaagccgcctattacctattcattcaaagtgttgcaagctattgagaagcgagtaggcgcaaagcttgtacccgatgtaatggaaaacgttaccactcccgaccaatacgaactattggaaatgagtaaaatcagcggattcattgatcgcgcacggggaaccggacgtccaaccaaaaaagaccgcagaagtctggaggaattcacagctccggaatttatggatgattttgatttcgactttgatttcgacgaagataagtaaataatgaacggtgaataaacttatagcatgaagttacaagtttattcaccgttcactattttaccaactattggttagagatttgctttcacagcatcaattagttcctgatattcagcatcggtcaaataaacttttcccggattcatctggaatataccaccataatcaggtccgtctacatatttcggagccagatggaaatgcagatgagataatttatctgagtaagcaccatagttgatcttttccggctggaaagctttctgcattgcacgggtaacacgtgccacatcagccataaatgcattacggtcttcatcgctcaattcgttcaaatcatttacgtgatccttgtaagcaacgaggcaacgcccccgataagtttgctctttaaacaaaaacacacgtgatacactaagttgcgcaatctcaatcatcagattatgcaaagtttcattgttctggcaatacagacattcttttggatcactcttcatgatattcttatttttatgttttgacaaagcaaaaatagtcgttctgcttttatttcacctgtattttttcgtttttttgatcgactaattggtacacgttctctttttcaccgacaacccacactacatctccctcttcgaacggtgcatttacatccggcaccatcagagttccatcttcccgttccacaccggctatcatacaatgatacttatcccgtatacccgattcacggattgttttacccagaaaaacggagtctgcatcaataataaactgcttcaaagtcatctctcccttctcatacatctcccagtctatcttcgcaccactttgcatggcactgctaaatacattcaattgttcgtccgttcctattacctgtatcttgtccataggaaaaagacgcaccgagccaccgggaatattaatccttctcttcccccgcaagatagaagcgatatgaatgccatatttctttcccaaatttagttccatcaacgtttttcccgcccaagtggattcccccggaatctccaaatccgccaaatgcagatcatgagataacagacgtccggcatattcgggtttcttctctcccaaatattctgcacgcacctctctggaacgcagattttgaaagaaacgccgttctatcaatatagattgctttttcaaacgacgcgaccataccatcaacaagactgcaagcacagccactccaataatcaatccaatagatgccttaaacaatcccgatatcacaaaaatgacaaataacgccgcaatcataatacgtatgacaatagtagacaccaatggtgcacgattggcacggttatcatgccacagggtcataaattccaccgaatggtttttcttcaccatgatagcacgcaggaaaggcgaaatgcaaaggataataaaaacagcccccaataatgacgcccagaaatgaggcaggttctccttaaagaatgggacgacaaaacggaaagacagtgcaataatggatatactgacaattgaatataccacagttatgcgtaccattgccagcaacagcttcttccacaaattctcatgattaagtactgtttgcgagcccgaagaataacgcattaagaactttctccaggaagcgggtaaatgagcatccacaaaagaagaagccggttcagccagacgaatcatataaggggtcaggaaagtggttatcacagaaactgctaccactatcggatataagaaatcgctcgtcacgtgcagagatacacccaatgaagctataataaatgcgaattcaccaatctgagtcaaactgaaaccgcactgcatagccgtcttcaagggtttgccggaaagaatcacgccgaatgttccgaaggtagcctgccccaaaataactgcgatcgtaattacaatgataggtattgcatattcaataatcattgcaggatcgaccatcatccccaccgatacaaagaaaattgcgccaaaaagatctttcaccggcttcaccaaccggtcaatagattccgcttcgattgtttctgccagaatagaccccatgataaacgcaccgaatgcagcagagaaccctgtattggctgccatcactaccataccgaaacacagtgccaatgatacgataagcagagtttcctctcccatcagtttcctgcaacgcttcaaaaactccggaatcagatagatgcctactacaaaccacaaaataagaaagaacagcagtttaccaatactctccagcatctcggtgccttcaaagttatggcttaccgccatcgtagaaagcatcaccatcaatacaatagccagtatatcctccagaatcagaatactcagtacaagcccggtgaactgcttcttcctcagtcccaagtcatcgaacgccttataaataatagtggtagaagacatcgcaatcataccacctagaaacagactgtccatccgatgccagccgaatcccataccgacacctatccccagcaatatcatacaaaagatgatggtgcaggcagcgatgatagcagaacctccgacttttacgattttcttaaaactgaactccagaccaagagcaaacaacaagaagataacaccaatatccgcccatgtcttaatgttggcggtatccattactgatggtgtataaggcatgtgtggacttgccagaaaaccggcaaccacatatcccaacaccaaaggttgctttaacttcttaaacaacaaagtcataacgccggcacagatcaatatcagcgcaagatcggcaatgagtgtaggtaattgagacattgtttcatcgtatttggtgacaaaattaaaataaatctatcgtataaacaacagattcacggatatgtttcacatcaaccatcataaaataatttagccccggatagtatcaaaacctatccggggctaaaaattttataaactcaagatttattttctaaaaggtggcttcaccactattgccttcaatttacgtccacgcatatcaatacaaatttccgtgccaactttggcatattccggtttcacatatcccataccaataccaatcttgcgagtgggagacattgttccggaagtcaccacgcctataccttccccttcctcattcacgagttcatagccatgacgaggaatgcctcggtcaatcatttcaaacccaactagtttgcgggtagttccttctgacttctgcttttccagcatcggacggttaatgaactccttaccctccacaaacttagtgatccatcccaatccagcttcaatcggtgaagttttatcatccagatcattaccatacagacagaagcccatttccaaacgaagcgtatcacgggcacccagtcccaccggcttgataccgaattcttcccccgcctcaaacacagctttccatatcgcctcggcagcatccggatagaaataaagttcaaaacctccggcaccggtatatccggtattggagataatcacattctctttccccgcaaaccggccaacggtaaatgtataataaggaatagccgacagatcgatatccgtcaacttctgtaaagcaagaatagccttcggcccttgaacagcaagctgcgccatattatcggaagaattctccagctccgccccctccgtattatgagaaacacaccagttccagtccttttctatattggccgcattcactaccagcagatatttttccggctcgtagcaatataccagcaagtcatctacaattcccccttcttcattagggaagcaggtatattgtatcttaccgggaacaagtgccgccacattattggaagtcaccttctgaagaaaggctaacgcttgcggccctttcacccagaattctcccatatgggatacatcaaataccccgactgcattacaaacagtcagatgttcatcaataattccagagtactcgataggcatattatagcctgcaaattcgtgcattttagcacctaatgcaatgtgtttctctgtaaacggagtggttttcattttttgtgtattaagttttaagtaataaattgatattcgtggaatgtaatcacttggaagctaccagttcggcaatcttcacaatgacgttcattgccttctccatattctgaataggaacaaactcataacgtccgtggaaattaagaccgccggcaaaaatattcgggcagggtaaacctttgaatgaaagctgcgctccatccgtaccgccacgaatcggcttcacattcggcttcactcctaccgcctccatggctgcgaaagcagtgtcgatgatgtgcatcaccggttctattttctcacgcatattatagtattggtcacgtaattcaagtgtagccgtaccttctccatattcggtgttgacctgcgcaaccagacgttttatttcttccttgcgtttctcaaacttggcacggtcatggtcgcgaatgatataagacactgtactttgctctacatctccctgaatactgatcagatgatagaatccttcatacccttcagtctgctccggtgtttccgtcgatggcaacattgcgataaactgattagcgacacgaatcgaatttatcatcttattctttgcatatccggggtgtacattacgtcctttaaaagtaatctttgcagcggcagcattgaaattttcaaactccagttcccctacttcaccaccatccatcgtatacgcccattcgcagccaaacttcccgacatcgaacttatgcgcaccttcaccgatttcctcatccggattgaaaccgatacgaatctttccatgtttgatttcgggatgttctttcagataaacgattgctgatacgatctcggcaattcccgctttatcatccgcaccaagcagcgtcttgccgtttgttacaatcaaatcctctcctttatgatcgagcagttccggaaattgtgcaggagaaagaatgatattttcttcggcacaaagcactatatccgtcccatcgtagccttttacaatacgtggagttacatcttttcctgtcatatcgggacttgtatccatatgagcgataaacccgatagtgggtacttttttatctatattagcaggaagcgtggcaaaaagatagccatgttcatccaaagtaatatcttccaaccccaaagattccagttcagtcttcagatattcagcgaataccatctgtttcggagtactgggagtaagccctgttgattcatccgactgtgtatcaaagctcacatacttcaaaaatctgtctactaaagtcatatctattttacgatttaatgatttgcaatttacattttgatagtttatagtgccgtaaaggtaaaaaaagagccgtgaattgacaaacaattcacggctcttttttctcagtatattacttaaaagtgactgctaccatcaaaacaatgcgtacacactttacatttcggcagcccgatagcttcaatcaaagtctcaagcgtgttgaatttcaatgaagtcagtccgaaacgctcggctatgatactaaccattttctcgtattcgggagaccccgtagtggcgtatttctccagattcttattctcatcgccttccagttctttaataatacgacgggtaatcaactccaaagcattcttagaagccgagaaacccacaaacggacaggcatagatcaacggagggcaagcgatacgcatatgtacctctttcgctccataatcatatagaatcttcacattatcacgcaactgtgttccacgcacaatcgaatcatcacaaaacagcagacgctttccctgaagcatggcacgattcggaattagcttcatctttgcaaccagcgaacgcatttcctgattgctgggtgtgaagctacgaggccatgtcggtgtatattttgaaatggcacgatgataaggaactcctttaccttccgcataacccaacgccatacctactcccgaatcagggataccacaggcacaatccacttccgattcgtccttctgtcccatcttcattccactggtgaaacggacttcctctacatttttgccctcataacaagaggtcgggaaaccataatacacccaaaggaaagaacaaatctgcattccttcattcggttggcgaagctgctcgatatgatcgggatacatgcgtactatttcccccggtcccagatacttttcgatttcataatccagattcgggaaactggatgactcgctggtagcggcatacgcaccatctttcttgccgatcaccaccggagtacgtccccattggtcacgagccgcgataatactgccatcctctgtcagaatcagcagagaacaagaacccttgatatgtttgaatacgttctcgataccttcggtgaaggttcttccttgtatgataagcagtgcgatgagttccgtttgattggtgttgctcgaactaagttcggcgaagtgcatattttggttgagaaggtcttcttccagttcctggatattcgatattttagcgactgtgacgatggcgaagcggccgaggtgggaattgatgataatgggttgtgcatctgtgtcgctgataatgcctatgccggcattgcctttaaatttatcaagctctccttcaaacttggatcggaaatatgtactttccagattgtgaatggagcgaataaatcctttctcctgactataagtcgcgagtccgccccgctttgtacccagatgtgagttataatctgtaccatagaataaatcagtcacgcaactcgatttcgagactgttccgaaaaaacctcccatgttgttctctttattgataatgtttaaaaaaagatggcgcaaaagtacaaaaaagaatccatccgataaaaaaagcactccgcaaagttttaattttctttgcggagtacttctaaattttattaaaaatacaaagaagattgaacaatcgttttagtcgcgtctcatttccatttcttaattgatttccggtcggatggagctgcttcgataagactcaatgcaaaaccaccgctgcgtgccagcttgacggacatctttgttttattcgtaacgatccctttctttatctgataggaagtcggattcttttcgtagtcagcctcttttccgtcggcatacagggtagccacatactctttatccggttccagaaaatcaagagtaaacgcggcagtacgggagttttcgtcagtaataccgccaacaaaccaatgattggttccttttgctttgcgggctactgtaatataatcccccggttcggcttccagatatttgctgtcatcccagtccaaggctacatctttaataaactggaaagcatccggataacgctcataactttccggcaaatcggcagccatctgcaaaggactgtacattgttacgtaaagagccagttgtttcgccagagtagtacgtacaacgctatgcttcccatccagaaaagaaattctcgtgtcgaagatacccggtgtataatccatcgggccgccgatctgccgagtgaatggaagcaaagtagtatgaaaaggtttattaccggcaaaagcttcatattccgtcccccgtgccgattcattgccgatcaggttgggataagtacggcataatccagtaggacgtacagcttcgtgcgcattcacacagattttataatcggcggctttcgtcacggcatatagataatggttgttcatccattgtccatagtgatgttcgccccgaggaatgatattgccaacataaccacttttcacggcattatatccgttgtcaaccataaattggtaggccgtatccagatggcgttcgtagttacgcacggaggcagatgtttcatgatgcatcatcagcttcacccctttctctttggcatatgcgtttagcatcttcacgtcgaaatccggatagggagtgacgaaatcaaacacataatcttttgatttgccgaaccaatcttcccagccttcattccagccttctaccaatacctgatcgaaaccatgctgcgctgcaaagtcgatataacgttttactttgtcattgttggcagcgtgacgtccgttagggcttgtctttgagtaatccgtctgtccgagtttgacggaataaacatcatctgtatatgcccaactgctttttccggtaatcatctcccaccacacaccgatatacttcaccggtttaatccaagaaacatcttgataagcacatggttcgttcagattcaaggtcagtttggaagcaaggatatcgcgtgcatcatcgctcacaatcaccgtacgccacggagactgacagggtgtctgcatataacctttatctcccattgcatccggtgtcagccatgattcaaaaatcagttttttgtcatcaagattgagatgcatgcaggaataatctaccaaagcggcttcgtgcaggttaatatacagaccgtcggctgttttcatttgcagagatgtctgcacgcctgttggtgaaaaagacgtttgagaagcattgtcggtaatagcccctttcatcagtccacggatttctgttagtctggattctgtgtaatcatattcctgggtatcataatctcccggaatccaaaaggcagtatggtcacccgtcatggcaaactgcgaatgttcttccttaataacaaaataattcagattcttctgctgcggaaattcatagcggaaacctaatccatcattgtaaagccggaaacggatgatcatattccggtcctgcgccttctgattcagtgtgacagccatttcattataatgattgcgaatggatttcacttctccccacaccggctcccaagtttcgtcgaaggtggaagtttttgtatcgatgcacgcaaacccattcatcagtcccggatcattcttcaactcaagtcccaactttgatggtttaatcactccctttcctttataagtaagttcgtataccggttctccctgaacattgaccgaaaaatccagttttaattgtccgtcaggagaagtgatactttctgccattgccgttgcacccatagaaaaagagagtaacagacagagtactgccgtagttaatattttcatgttcttcatgatataaatgaattagttaataatcatatggcaaatgtagtgaggaatagcaagcgccacttcggattataattaaaatatagcgtttccgaatatttcaacactgataaatacctatcaataaagcatataccaaagtacttcaacagaaaaaatatagtgcttacatggagcaatatagcaccttttcacatccgacaaacgggatttttctttatttccccgcctctcttcagaaataaaaaaaatattttaatctcatactctcatcctatgacaactaatatatagacaatcagcacaatacagaatgagagatactttttaaatagttatctctcatcatttcctcatcaaatagctttctttttgactacctctcattcatatttcagttatctctcattcgtctcaaagccgataatccattgtactatggcaagccttacagaacatggaacctaccgctactttgtatataacatatagtatgtgggtatgtatatcatctattaatactgtatttttgaagggcagggaaaacgcattataaatcatgtaaaataagttcccataagaattcattatcccaccctgctattaatctttttctattgattggtatctctcttttgttgtttctcaatgtggccaatgcaattttcgccagtacggagaagtttaatgctgatatatttcttcttctggtattgtcttcatggaaattgacatccaactgccaatgtagattattctcaatttcccagtgttctctactatttttaagtatcttctgcgcatcaggttccaaggaagatataaaacatcttttttccactgtagtgcctttgtttgtatttctggtattctcaatatatccaaaagaccgtatatttttccacttctttctaatatctgctcccagaaaaccgggatcgttgcagcaatagcagattctcgactcattcctgccatgtccttcctcatgcgtctcatatttgtcaaatcgtactgttgtaccttttgatacaatactttctgttgctgacagtactgtttcctttaatttcggttgattatctttcactataaaaatgtagtcaccttctccctttatgactttctctgcaattgtacgctggcatcctaaagcgtcaattgtaataatacaatcttttatacacaacatatctaataattcaggaatgacaactatctcattttccttttcttgtgtgcataactgtccaagggagattcccagttctgttgcaaatgcactaataacatgcaatttgtattttcccgtattcgaatcaggaagtactccttgtttacgacgacgcttgtcctcttcggattcataggctcctcgtatggttttaccatcaatggctatatgacccgaataacatttgagaatgctttggacccattgtctataagattcttcaaattttaaaggatctaatgccgagaaaaagcgattaaatgtatcatgagaagggatgccattaaaattggaaagcttggctgcaaaaaaagattctttacttttaccaaagtcttctattgaattccaagtatcagcgccacatataacagcagaaatggcaataagaacaatggtactggcctgatgctttttacaacgctctatccggttatctatcaatattaatgaatcagcaaattcatgtaggttgctgatctcaatccttcttttagtttcttgcttcattttaattgtgatttataatcacgtaaatgtacttaaataatattgtaaatgaaagataaatatcttattaataagatgaaaagacgatattcatgtaagataaatgtataaaagataaaagaaaaagtataatgcgttttccctgttttgaagggatattaccatcgttccactccagtgcacagatctcatcactcttgtgaagagttctcatcactagagtgaacagacctgttcactctagtggaacgataaagatgtgtacttccctaataatggttgacttgtttatctctaatagctgctatgtgttgactagaaatattactaaccctggctcagatttgctctcgggacttgataaatactcacgaatataagacattcgttcatcatcactgtaatagttgtacttctttttcgaatatttcatctttattttcgatttttgaagtgtcaacttattcagtacactacaggaaacatatcaagagaagggacccaatgaaaatcatctattataatgataatattatttaggcacggattgcacgaatttcacggtctttaattgaatagaaccgtgttaatccgtgaaatccgtgcctaaatgaaaataaatagtgttttgattacatattcgtgcagtcaattctttatttatatccggcagctttagctatccgtttcggaatttccgtattgtcaatcttctcaccgaacagttgagaaccggcaccgatagcaaataccggcacataaccggcagagtgaccgccgcttacccagcctaccatagatatctggtccattacttctttagcgcgtgcagccatcggctcgcttttagagtacatgctttcggcaaataccactttatttctgacaaaggattgttcgaactcgtcacgcagcttcttttcctgttcccaggaaatagggaactgtttccagaagcccatttcttcacccaggaattctttcatgtcttcccaagtcactttgttgccttttgattttcttagttcgctgatacgtctggacaatccgtcagcagaatgtttttgatattgcaatgctttcaggttcaacgcatatttgcctgtacctagtacgataccaccggtttcgtggtcggccgtaacaacgatcagtgtttctttcggatgtttcttgtagaattcgtaagctactttgatagcgtcatccatgtcctttacttcattgaatacggtagcggcgtcattaccgtggcaagcccagtcaatctttccaccttctaccattaagaagaatcctttgttcttgcctttggtcaggaagtcgattgcgctttctgtgatttgggcgagagtcaagtcgtcgcttttacggtcgatagcataaggcaggcaggatggatctttgccttcttcctgtatcaggatcattttgccggcatccttgcttttggctttataatcgctgtagccacgtgctacggtgtaacctgcttcttcgaaaatagggaagatgttgggagcgtctttcttgtcatacgtcttgtccggtttcagaaaaccaccgcctgcatagaagtcaaagtttgcttttgtcaggtcgacagcgatttcataattcatattacggtctgcctgatgagcgtagaaagcggcaggagtggcgtggtctacgctgacggaagtagtgacacctactttctttccggccttcttggctttttcggctacggtttcaatcgggtttttgtcttctcctacagagatggcactgttgtaggtcttctttccggtagccagtgcagtacccgcagcggcagagtcggtaacagagtttgtcgcggagaaagtggttgccatcgttgctaccggaaattgggtgaacaataaaggttcaacgccgatgcgcccgttttgcagttctgcctgatacatctctgtaccatttacctgattgactcccattccgtctccgatgaaatagaatacatactttgcctgctgaccgttggctgcaacggaaataaggacaaagagcagtgtgtaaatcaactttttcattcttttgtatcttaatattagggttagtgatggacaaaggtaataaaaaacggtggaagtgccgaagcaaatccaccgtttctttatgtcatttgtatgacatttatgcttttacgcgtcctacgtaagaaccgtcacgagtgtcgatttcaattgtttcaccttcgctgatgaacaaaggcacacgtactgttgcacctgattctacggtagcaggtttcagtgtgttggtggctgtatcacctttcattcccggttctgtataagtaaccttcatctgaactttgatcggcatgtctgcataaagtacagtttcggtagaagcgtcagaaacaacgtccagcactgcaccttcgagcaagaagtctacaccattgatcaggtcgtgagcgatggggtgttggtcaaaagtttcctggttcatgaagatatagtcttctccttctttatacaggaattggtatggacgacgttcaacgcgtacatcttccagtttttcaccgatattgaaacggcgttcgagaacataaccgcttactacgtctttcagcttggtacgcataaatgtgttacctttacctggttttacatgcaggaattctatacagaaatagagctttccgtccatacggatacaagttccgtttttgatgtcttgagcattaatcatactgctgtttttcttattatattattgttatttaattgtcttcgtcgtaattcgagtgcaaaagtaatctaaatcagtaaaaaacacaaaaacttttgagcaaaaatgacttatcgcttggttaatttaaaaaaagtctctatttttgcagcccgattacgtagaataataacataaaaacaagatacagtaatgaaaagaacatttcaaccctctaacagaaagagaaagaacaaacacggtttccgtgagagaatggcatcggctaatggtcgtagagtattagctgctcgccgtgcgaaaggcagaaagaaactgactgtttctgatgagtacaacggacagaagtggtaatcatcactcagaaacaaaaaaggcggagttttaaactccgccttttttgtttgcttctattttcattaaagttggttataacttcctttttatgataaaaagtacaggactcttggcacagtagttaaatagagtattaaataatgtttaatggaatgctctttgtcactttttagctttctttgtcacagatcatagacggaatatatgcgacagacggttgtgctcagagaatccggaagccgcatcctagaatataaggttgttgaaatctataggagtggggaatatagttgcaacaattgtggtgatgacaggtgtccttgcatttatgcagggacattttcattgcccactattccgaaattcaactaatttgtagtatctttggcgcggattaacagcaaagcgtatgacaatcaaagaattcttttcttttaaaacaaataaatatttctgggtgaatatccttgtcatgattgtggcagtggtgctgattgtgttcggcgtgatgaaatggctggatgtttatactcgtcacggtgaggcggtggttgtgcccgatgtaaaagggatgactgtggatgaagcttcaaaaatgttccgcaatcacggattggtatgtgtcgtttccgattctaattatgtgaagaatatggcagctggcattgtacttgatgtcaacccgggaatcggacaaaaagtgaaagaaggccgcaccatttacctgactatcaatacactgagtattcctttacgtgctgttcccgatgtggcggacaacagttctctgcgccaggcacaggcgaaagtgcttgctgccggattcaagctgaccgagattcagttgatgaacggtgagaaggactgggtgtacggcattaaatatcaggggcgctcattgaatgcgggagataaagtacctttgggagctgcattgacactgatggtaggaaacggagaaaacgaaccgttggaaagcgactccatggaaaatgttgaaggggcagatgaacctgtttcctcagaatccccttcaagtcaggatgatagttggttttaattgataaataacgaaacagattcacatgatcgaggaagaacttccggatgaactggagaatgatttggatgatatagaacctgtcggtgacgaatcccagctttacgaacattttcgggtggtcgtagacaagggacaggcgatggtcagagtcgacaaatatctgttcgaacgtattgtcaatgcttcgcgcaaccgtattcagaaggctgccgaagatggattcgtcatggctaacggtaagccggtgaagagcagctacaaggttaagccgctcgatgtcattaccgtcatgatggaccgtcctcgttatgagaacgagattattcccgaaaatatcccccttaatatcgtttacgaagatccatatgtaatggtagtgaacaagcctgcgggactggtagtacatccgggacacggaaactatcacggtacgcttgtcaatgcgttggcatggcacatgaaagatattcctgaatatgatgccaatgacccgcacgtcggcctggtccaccggattgataaagatacgtccggtctgctggtgattgccaagacgccggatgccaagaccaacctcggaatacaattctttaataagacgaccaaacgcagataccgtgcccttgtctggggaaatgtggaacaggatgaaggcacgattgtaggcagtatcgcccgtaatccgaaagaccggatgcagatggcggttatgtccgacccgtcgatgggcaagcacgcggtcactcattatcgggtgcttgaacggctgggatatgtcacgctggtagagtgcatactcgaaaccggacgtactcatcagattcgtgtccacatgaaacatatcgggcatgtacttttcaatgacgaacgctatggcggtcacgaaattctgaaaggtactcactttagtaaatacaaacaatttgtaaataattgctttgacacttgtccccggcaggctctgcatgccatgacattggggttcgtacatcccgtcacaggcgaagagatgtactttacttccgaacttccggatgacatgacccggcttatcgagaagtggcgaggctatataagtaacagagaaatagaatgaaacgcacaattgctatcgtagccggaggtgacacctccgaatttcatgtatccctgcgtagtgcacagggaatatattccttcatagataaggaaaagtacacactgtacattgtcgagatgcaggggacccgttgggaagtacaattgccggatggtgcaaaagcaccggtagaccgcaatgatttcagctttatgctgggaacggaaaagatcaggtttgactttgcctatattaccattcacggtactccgggcgaagacggccgtcttcagggatactttgacatgatgcacataccatactcttgttgcggggtgctggctgcggcgatcacctatgacaagtttacctgcaaccaatacctgaaagccttcggagtgcgtattgcagaatcgttgctattgcgtcagggacaatcggtttccgacgaagatgtgatggaaaagatcggtttgccttgtttcatcaagccgagtctgggcggttcgagcttcggtgtaacaaaggttaagacgaaagaacaaatacagccggccattgttaaggcctttgaagaagcccaggaagtgctcgtagaagcattcatggaaggaacggagctaacctgcggctgctataaaaccaaagacaagaccgtcatcttcccgcctacggaagtggtgacacataatgagttctttgattatgatgcaaaatacaatggtcaggtagacgagattactcctgcacgcatctcggacgaactgacgaatcgcgtgcaaatgctgacctcggccatttatgacatattgggctgttccggtatcatccgtgtggattatattgtgactgccggcgaaaagatcaatctgctggaagtgaatacaactccggggatgaccactacaagctttattccccagcaagtgcgtgctgccggactggatataaaggatgtgatgactgatataatagaaaataaattttaggtattaagtattaggtaataagtattaattccatgcggtttacagcgcagcctaatacttaatacctaatacttatttataaacttcatagcttatggatactacagagtttgatgagattcgtccttataatgatgaggaacttcctcaaatctttgaggagctgattgctgatcctgcttttcagaaggcggctactgatgcgataccgaacgtcccctttgaacttttggcgcagaaaatacgtgcctgtaagagcaagctggattttcaggaaacattctgttatggtattttatggaaaatagcggcggaccatacggatgggctgactctggatcatacggctgtgccggataagagcaaggcttatacatatctctccaatcatcgggatattatattggattcgggcttcctctctatcttgctgatcgatcaggggatggatacggttgagatagcgattggtgacaatctgctggtttatccgtggatcaagaagctggtgcgtgtcaacaagtcgtttattgtacaacgggcgctgactatgcggcagatgctggaatcttcggcacggatgtcccgttatatgcattataccattagtgagaagaagcagtccatctggattgcccagcgcgaaggacgtgccaaagactcgaacgaccgtactcaggacagcgtgctgaagatgctggcgatgggtggtgaaggtgacttgatcgaccgtttgatggagatgaacatcgctcctcttgccatttcgtacgaatatgacccctgtgactttctgaaagcgcaggagtttcagttgaaaagagatatagaaggatataagaaaaccactcaggacgatttgatcagtatgcagaccggtcttttcggatacaaagggaaagtgcattttcagacggctccctgtatcaatgacaggttggcgcagctggaccgttcgttaccgaagcaggaactgttctccagcatatctgcctgcatcgaccagaggattcatagtaactatcggatctattcgggcaattacgttgcctatgacttgctgaagggtacatccgagtttgccggtcattacactcccgaagagaaacaacgattcgttacctatatcgagcaacaactgggcaaaataaagattccgaataaagacgaagactttttgcgtggaaaattgttattaatgtatgccaatccgttggtgaactatttagctgcttgccaatgaataaagtaaagttacatacactctggcttttgggaatgcttttcctgatgactgcctgcggggatgatgattactattatccttctgtgaagttggaatttgtcacagtgaaggctggggcggatggtctgatacagagtctgcttcctgacaagggagagctgttgactgttgcgaaagaccgtaccggatcaaccatttctccgaactcggctaggcgtgtgatcagtaactatgaagtaaatccggaggatgctacggctgtcatatactcattgcagtcggtggtgacaccggagccaaagggggctgacgatccggctttcgaaggcggactgaagtatgatccggtagatgtgaccagcatttggctggggcgtgactatttgaatatgattctgaacgtgaagatcaatatcaatagtggcaaacagcacgtgtttggtatgatagaagagagcgttgaggcggaaggggatgagacagtcgtaaccttgtctctgtttcatgatgcgaatggggatgaggagaactataatcgccgtgcctacatttctgttcctctgacgaaatatgtggatgaagaaaatcctcatcaaaccataaggataaaattcaagtatcataccacagataaaagtggtgtggtggtagaatcaagcaagtattgtgatccgggatttgaatatgttccgggcgtgaactgattaagatagtacatatgtttaaaatgaatcaattagtcgtgggattatttttatttctctcttctcttttctcctgtcagcagaaaggagactttaaaacggtgaatgtagaggatttcgattctatcattcaggatgaagaagtgcagcgtctggatgttcggacactggctgaatattcagaaggacatattgcaaaaacgatcaatataaatgtgatggatgactcttttgcctcgatggcggattcattgttgcaaaagaacaaaccggttgcgttgtattgccgtagcggtaaacggagcaagaaagctgctgcgatccttagtgaaaaaggatataaggttgtggagcttggtaaaggattcaatgcctggcaggcggcaggaaaggagatagaatactaaggttgttgtacggctttttactgtctattctagaataaatggttacgctctacatgaaattctgaagggatgcaatcgttatcgtgctagtatacaatcaaatatatgttgctatattctcaatgtattctcatgcttatgagaaaaagttctcaccacaatgagaaaagattctcatacctatgagaaaaatttctcaaaggcatgagaatcttttctcataggtgcgagaataaaagtaaggtttcattcacagatgttccgtttactccaatccctcaatcaatctcttcaaaaccaccgtagccgagatttcacggttggcagcttcggggataacgatagactggggactttcgattacatcatccgtaacgatcatatttctgcgaacaggcaggcagtgcataaagaaagcattgttggttactgccatctgtcggtcgctgactgtccattcacggtctttgcttaatatctggccgtaattgtcgcctgtataggcagcccagttcttggcgtatataaagtctgctccttcgaaagccttcatctgatcatattctaccttggcatttcctacgaattgaggtgccagctcatatccttccgggtgagtgataacgaaatcatagtcagtggcattcatccactctgcaaaggagttgggaacagcctgtggcaatggacggggatgtggcgcccaagtcattacgactttgggacgtgccgtctttttatattcctcaatggtgattaaatcggcaaagctctgcaatgggtggcgggtagctgcctccatcgagaagacaggacgtccggaatattggataaattgattcagaatagtctcctgatagtcaaaatcacgatcttcgaaacgggcaaaggaacgtactccgatgatgtcacaataacaacccatcacaggaatcgcttccagcagatgttccggtttgtcaccatccatgatgacgccacgttctgtttccagtttccatgcaccttggttgatgtccagcaccattacattcattcccagattaagagcagctttctgtgtgctgaggcgggtacggaggctggaattaaagaagatcatcatcaatgtcttgtttcgtcccaactctacatatttgaagcggtctttttgaatttcaaatgcttctgcaagggctgattttaaatcgccgatgtcctgtacacaagtaaatttcttcattttatctatcattaatcgttattgtccaattgatcatttgtcgtttcctcactttaccatctggtctgtccgtcgccttcgatcacccatttgtaggaagtgatttcctccagtcccatcggaccgcgggcatgcagcttttgagtactgatgccgatttcggctcccaggccgaattgtgcaccgtcggtgaaagcggtagatacgttggtatatacgcatgccgcatctactatcttagtaaacaaggcggcacgctctttgttttcggtcacgatacattcgctgtgccttgaactgttttcctgtatatgccccagtgcgtcttcaaaacttttcaccgttttgacagccattttgtaatccagaaactctcttccgaagctttccggggtggcaggttgcagcaactcagccggataatgtccttccagtgcctgataagcctgtgtatctgcatagatagtaaccttgctttttttcagttgatcgcagagcgcaggcaaatctcccagacgtttttcatgaatgatggtgcagtcgagcgcattgcagacactgacacggcgtgtcttggcattatggataatatccgctcctttccgggtatctccgaactcatcaaaataagtgtgacagatacctgctcctgtttcaatgacaggaatccgcgcattctcgcgcacgaaatttatcagattgctgcttcctctcggaataatcaggtctacatagcctgtcgcattcagtaatgctgccgtagcctctctgtcagccgggagcagttctactatatgcggattgacatgaaacttttcgagtaccttgtgaatgacactgatgatggcacggttggaatcgtccgcatcacttccacctttcaggatacaggcatttccgcttttcaagcaaagggaaaaaacgtcgaagctgacattaggacgcgcttcatagatgatgcctattactccgaaggggacactgactttggtcagcttcattccattggggcgggaggtttcctttaaaatccttcccagcggggaggggagagtggctacattacgtgtgtcggcagcgatgcctttcagcctctcttccgtcagttttaaccggtcgtacttcgggttactcttgtccatccgtgccaggtccttttcattttctgacaggataaagggtgtttcggcaatggcagcatcagcgaccgcgttcagtatctgattgatggtgtcgtcgctcagcaatgccaattcccggctggcagcttgtacagcagcgaaagttccgtttaaatttgtagtcatttgctcctttttacgttttatgttttttattcgatatacagatagtcgtaatgtactacaggctttttgccatgtttgcccattgcttccctggcctgtgcggagtcgcagttcgcttttcctacaccaacctgattgccctggaagtccatgatgcgtacaatatcgtctttctcaaattcgccttcgatgtgggtgattccgaccggaagaatgctggctgccttctccgagctgagtatatccgtggcacattcgttaatatggatttcccctttggcgaatccttcgctgtgggcaatccatttctttacactggataccgcctcggtggaagggataaagcgcgtgcaaaccgtatcgtccggttgttgcaacaagtctacgagaatattatcccgttttccgttggcgataatgactgtaatcccttcgtcggctaccttgcgggcgatattcgtttttgtcagcataccgccacgaccgaagctcgatttggtagcctggatatagttggataaatcctttccgtgctcgatttcacgaatgacagcggaggcaggatcggagggtgaaccgttgtagattccgtctatgttactcaggataatcagtgcctgcgcgtccatcatggaagcgattagcccggaaagttcgtcattgtccgtgaacataagctcgctgaccgaaatcgtatcattctcattgacgatggggatgacgccgttttcgagcatcaccgtcatgcagttcttctgattcagataatggcggcgggtactgaagttctctttggtagtcagtacctgacctaccgcaatgccgtgttcacggaaaagttcgtagtagcggtttattaatttagcttgtcctacagcggagaataactggcgctggtctacactgtcgagctttttctgcgggtgtatctcgctgcgtcccgaagcaacagctcccgaagaaataagaatgatctctactccggatttatttaattctgctatctggtcaacgagtgccgacatacgggtgacgtccaatgtaccgtcacggcgtgccaatacgttactgcctacttttactgctattcgtgtaaactcctgtttcatccttactaacgatttgaaagcacaaatatagagctttttgtcgatatgttacaaaaacaggctgaaaagaattatctttgcagcctgacagataaaagaaaaacaatgaaacatacgaatccccaagtagaacaaatgacctcctttatcgtgatggatgtattggagcgtgcaaatgaattacagaaacaaggtgtggacgttatccacctggaagtcggtgagccggactttgacgttccggcttgtgtggcggaagctgctaaggctgcctacgaccggcacctcacacattatactcactctttgggggatccggagttgcgtcgtgaaatagccgctttttatcagcgtgaatatggagtcactgtcgatccggattgtattgtcgtcacttccggctcttctccgtctatccttctggtcttgatgttgctttgtaactcggacagtgaagtgattctctccaatccggggtatgcgtgttatcgtaacttcgttttggccgctcaggcaaaacctgtcttggtgcctctgtccgaagagaatggtttgcaatatgatatagaagcgatccgtaagtgcgttactccgcatacggctggtatttttattaattcgccgatgaatccgacgggtatgttgctggatgagagtttcctgaaaagtgtggcatctttaggtgttcctattatttcggatgagatttatcacggacttgtatacgaaggacgtgcgcatagtattctggaatatacggataaggcttttgtcctgaacggattttccaaacgatttgcgatgacagggttgcgtttaggttatctgatagcaccgaaatcctgtatgcgttctttgcagaagttgcagcagaatctgtttatctgtgcgtccagcatcgcccagcaagcggggattgccgcattacgacaggctgactcggatgtggaacggatgaagcagatctatgatgaacgccgccggtatatgatcagtcgtcttcgggaaatgggattcgagatcaaagttgagcctcagggtgccttttatattttcgctgatgcacgtaaattcactaccgactcttatcgctttgcattcgatgttctcgaaaatgcgcatgtcggcatcactcccggtatagactttggaacgggaggcgaaggatatgtccgtttctcctatgcgaattcgctggagagtatccgggaaggactggaccgtatcagtcagtatctttctcgttgcggcttctgatcagttcagtagcggcttcgtactggtcttcagtgaccagaacagatacagatggagcaatatagggggctaatgtccccatgataccatctttaatgacgcagcggatgtcattactttccaacaatcccttgataatttctgcttcccatggagaaccggagaatacttctatggccctgctataatcttcttctttcataatcttatgctatttgaggttatgtatacaaatataacaaaaaagaaggaaagattgatctgctttcccatatttattcgagagaaattctttttacgtcgatttgctggttcaggaaggaagaggccgattcgacaaacttctcttccgcttctgtggtgtaaaacagacaactgccgttttgggtacatttagcattcatctccggatgtctgctcaggtagtccttcagactttcggctacatattctccttgtgcgacaatgcggatatgcttcggagtgtatttttgtatcttagggagcaagataggataatgcgtacagcccagaatcatcgtgtcaatttcaggatctttggatagcaactggtcaatgtatttccggatgaaataatcggccccttcgttctgtgattcattattttccactagcggtacccacatggggcatgctattccgctcacttgaatatccgggaatagcttatgtatctctaatggatacgattcggacttgatggtacctgctgttgccagtactccgatatgacggctttgagtaatgtcgcctatacactcaacggtagggcggataactccgagtacacggcgttcagggtcaatgccgggcaagtcattcatttgtatgctgcgcaatgctttggcagaggctgtattgcaggccaagataacgagatgacatcccatttcaaacaatttattgactgcctgcaaagtgaattcgtatacgatttcaaaagaacgtgtgccgtaaggagtgcgtgcattgtctcccagatagatataatcatattccggcagcgcctctcttatcttgttgaggatagtcagcccaccgtatccggaatcgaaaactccgattggcccgggtgtatgagatagatgttgcttcatgacgagtgcgattttatatacgcaaagttacatgaaaaaagggaaagagaaagaagtatgatcttcttttctctttccctttcggtattttatagcttatagcttcttatttgatgccgagctgtgtctttaccttaggagtcagattaatactttgtgactcattaacgtaagcaaccggtgttcttgcaaggtcgaagatgtagattacgccttcggcagcacctacagctttaattgcgtcgtccaactttttgtagataggagccattgcgtcagcctgagctttttgcatctgctgttgagcttcctgttggaactgctcttgtctttgcatcatatcctgcagttctttttgtcttctctcagcgatgttagcaggaagagagtccttagcgatagcttgctggaattcctgatatttcttgttgaattcttcctgagttctttgtaattcgctggtcagttgtttgtctagtgcttcaatatcagattgtgccttagcaaattcaggcattgctgaaacgatttcttgggcattaatatgaccgaatttcagattttgtgcaaatacacccattgggagtgcaagcatcaatacaagtgcaattttttttagcatagttctataatttatttgaatgatttttagttattttcgatgcaaatgtatgaaattaatttgaatatcctaattttctcagcacttcatcactaatatcaatacgtggattggcaaaaatgatgcctgcagcagaggctctgtcgagtacaaggtcgtatccgtgtagttgcgacagttcctttacagcaccatatatttcatcctgaataggattaatcagcttctcctgcatcttagccaattcgccttccggaccgaagtatttgcgcttcagttcggcagcggatttctctttcgctacaatttcatcttccttcttagtcttctgagccgcagagagagtagaggactgagcttgatagtcctggaacatcttctgtgcttccttggcaattacctccacttcgctttgatatttcttcgtagcttcctgcaattgctcattagcgctttgatatgccggaatatttttcagaatatattccgtatcgatcaatgcaaatttttgtgcactagctgccatactgatggcaaacagtaacataatggatagaacagactttctcatgacgtttagtttttagttttatattagaattcttgtcctaagataaagtggaactggctgccgccgtattccttactaccatttatcttgtcgaaaccgtaaccccagtcgatacccatcataccaatcatcggcaagaagatacgaacaccgataccggcagaacgtttcaaatcaaacggattgaattttgagatatcatgccatgcgttaccagcctccaagaaacctaacacataaatgttagtacttgtttccagcatcaacggatatcttaattcgatgccgaggcgtgcataagcatacccttcttttccatatggtgtcaatgaactgttttcataaccacgcaatgcaatactttctgttgcataacttgagtaaccagtcataccgtcaccacctacgtcgaatgtaccgaatggcgatttcttatatttgttatagtgccctaacaacccaaattctgtacgtgtcatcaataccagacacttaggatgtgcgatataatccatcaacggagtatatgttttggctttaaatttccatttgtggtattcaacccatctatgaagtttattcatattatcttgggtaatacccctatcatctgttggatcgtagaaataacctttatagtctttaccatcaaacaatgagtacggaggagtaagctgaactgacagcgagaagtccgaacctgtacgtgggaagatcgggttgtcaatagagttacgtgccaaagtcagtgaaaggctgaggtcattacatttaccgttggttaccgggaaatactgccagtctttcaggttgtagcgttggtaagctagctctgcagacaaagtaaagtagtcatccggccatttcagacgcttaccccaacctagagaaagtccccacatcttgatagacttgtcggggtcatagtagttctcatagttgttgtaattgccatagttgtacataccatagccaccataaccgctatacatactattgtaatagttgttgaaatagctcgagttgtagtaacggctgctgatgtcagtctgaactgagaagaaagccgatacggaaagtgagttcgggcgtttacctccaaaccaaggatcgaagaatgagatactatatgactgatagtatttagcattcgtctgaccgctgatggtcaatgtctgtccgtcaccttgcggcaggataccacggtagttttcacccggacgcagcaagttggcaacagagaagttggtaaatttcagactcagcttaccgatgatacctgtttgtccccaaccggcagagaattctacctggtcattggctttagatgtcaaaggcagacctatatcaactgttccgtttacagggtccggctgaatatccggctgcagtttttcagggtcaaagtgtcccatctgctggatttcacgtaatgaacgcatcaggtcatccttgctgaacagctgtcccggacgaatacgaagctcacgacgaactacgttttcatacagacggtcgttaccgctgatgttgatcttgttaatcgtagcctgacggccttcatagattctcatttcgaggtcgatggagtcaccgacgatatttacttctaccggatcaagattgtagaacaaataaccgttattgtaatataagttaccgattgcgtcgtcatctgtagaggtacgttctcccagcaacttctggttgtaaacatcacccttcttcatgcggagcaggaagttcagctgttctgaaggatacagtgtgttacctacccatgttacattacgaaggtaatatttctgaccttcgtctatatccatatatacatctaccgtcttttcgtcgtattgtgctacactgtcctttacgatcattgcatcacgatatcccagctcgttatacttatctatgatcagctgcttatctgcttcaaagttttccggaacaaatttcttggtgcggaacagattcagaagtttgcctttttcattggtcttcttcattactttcttcagcttggatgttttgatggccgagtttccggtgatatggatagcgtgcactttaatcttttccttcttgtcgatatcaatgtcaacaatcacctgattttcgttagatggatcgtccttttgcgcgataatcacttctgcattcttaaagcctttatcgtcaaaataacgtttgatcaatgtctttgcacggtcaacggtattcggagtgatctgcataccttttaccatacccagtttgctttcaaggtctgtacgttctgacttcttcacaccatgatagcgtacatccgcaatacggggacgttgtgtcagactgatttttaaccaaatcttgttgccttctatcttttcggcagtaatctgtacgttagagaacaaaccatgtttccagtagcgcttgattgctccggtaatctcatcacccggcacggtaatcgtctgtccaacggacagtccggataatccgattaacacatagtcttcataattcttcacgccttcaaccttgatgtctgctatctcatactttttaggcgttcctgagtataagatgactggcttagagtcttcgtcagtgttggtattctgcgtaaagcccgtggctgcaaagcagaacaggcagataaacgttacgaatataaaggaaatacgataatgcatttatgttataatttgaagtttcgaattatgttagctgatttgttcactcgttttgccgaaccggcgctctctttgctgatactcataaatggctttacagaattcttctttatcgaagtccggccagaatgtatcacaaaaataaagctccgaataagcacattgccatagcaggtagttgcttagtcggatttctcctcccgtgcggatcagtaaatccggatcgggcataaagtttgtggtcagatgagcagttatgtattcatctgttatttgttcgggagatatttctcccgtttttgcaagcgttgcaatctgtcggactgcttcagtcatttcccagcgggaagagtagctgagtgccagtaccaggcaggttcctgtattattagctgtgtgttctatacatcttgacagaccttcctgcacttctgcaggtaatttcttaatatcaccaataatgcggaaacgaatattgttcttcatcaacgtttcttcttcgatagaatccaccaatagattcattaaagctgctacttcttcctgcggacgattccaattctcggtggagaaagtatataaagtcagatatttaacccccagacgtgcagcatcctcgataattttatgtaccgtttctgcgcctgcctggtgaccgtaagttcgttcttttccccgctgtttagcccatctcccattcccatccataatgatggctatgtgctggggaatccgatttttgtctattttctctatataggacatgttttgattataaggttcgtatttaactacttcttattactgtattagaaatccgagtttattaactctaccacgccagattttgtcaataccttgaccacctaccatccatatataatggtttctgtcaactaccattgtgtagtttacttcttttcccttgaagctggattcgtgaagagaaggatgttgtgttactcctccttcaagtttcaccggaggaagaattccgggaagcatgaacattctgtctacccctttccatacaagtaatgtcggggaggtatagaatttctggaatcccttagcatcatctttagtttcttttccacaaatgtaaaatgcgtcgttataatgtataatagacgggtctactaatttcggacagttgttatttgatggaatctccattggaatccaggctttaccatcttctgaagcccaaacgactgtagctgtgtcattgtctaaaccgtcttctgtattacccacaacgattgcattcaacgttccgctttcagttgcatatacatcggctgacaggttgtttatcgggaactctgcaggaacaactgttaatttgtctatatctttctcccatgttacatctttctctgcaaaactgaaatatttctctccattgatttctactatacctgctattccatttatctttttatggttactgccatcactgtcagaaaaactggttatcagattagtaacggaaacgccatcggaattgagtacttcatcttttgtccaagtcaaaccgtcattggaattatatacttccttattcttagtaagtaaatataacttgtcaacgaatcggataatggaggtaacatcagcaccatcaggaagtttgccagtagtttctttatcccatttttgaccatagtttaaacgatcagtaggagagcctgccggtattgctgtactgtaaatttcattgttttgagcgaataataatatcttgtccccaagcgttactaccttttgtttttcagcagtgttcctcacgggattgttcgctatagggtcttttccccaactgagtgaatcgggaaccatcgtatgcatccgtatattaactttatactcattctgaacctccatattcggtgcccataccttcagtaccagaaagttgtttttctcggttgcatttacatacttagtcaggtcaatagagtcgttaatattaacgattgaatcctgatcgttctgatctttcatcgtcacgataccggatgctgttgtcagcgtcttgatcagaatactattaatgatcgtgtcagcattgacaggcagtgaatccacattatatattaaacgactaacttggtcaattgtgaatttatagtttaccccataacctatagtgtcaagttcaaatgcgcgtatagtcgcatccggactataattgacttcgttatcattgtcaaggcaagacgtaataacgaatgacaccatgaaaaaactcgcaatgattgataaaaactttattctcatttgaaagattgtgtttatttacaagttgcaaaaataggaacattttttccgatatagaacattaaggggaagttttatataaaattatagataataacgctgtttttatcgacgtagaaccccttgaatagaactattttagctatttctcgaaaacataatgccaaatctgtctgtcgaagtgtttttcagtcgaataactaaaattatcgcttatttcaggtgctttaacaccggaattcagcttgcacggacatttctcaatatatacttcatcccatagttcggcatcaataaatgattggagcagctgacttcctccctctaccagtaaggactgtattttttgttgatatagcactttcatgatctgtggcagaatatcctgtgtgaattcaatcgtgcggtatgtgacgttcttcttgtccggatgtttttctgctgtaaatacgatggtgggtacttctccgtcaaacagacgcaggctgtggggaagagacaatgcacggtccaaaacgatgcgtaccggattccggccgtaccagttgcggactgtcagcgacggattgtccaacaatgctgtccgcctgcctaccatgattgcatcagtttccgctctctttttatgtacaagcatggaagtaagaggggaggacagtactacgggattgccgtctgttcgttctacatcaatgaaatgatcagccgattctgcccattttagtgtgataaaggggcggtgcagcgtattgaaagtaatgaagcgccggatcagatacctgcattctttctccagtacgcctactgtcacttctcttccggcgtcccgcaacttctgaattcctcgtccggcgacctgtgagaacgggtcttgacagccaattacaatacggggaatctgcttctcgataatcaagtcggcacaaggaggcgtctttccgtagtgtgagcaaggttccaggctgacataaatggtggaacggctcaataaagacttgtctttgacggaacgaatcgcgtttacttcggcatgcgcctctccgcagcggatgtgatatccttcgccgataataagtccgtcacatacgataacagcccctaccatcgggtttggagcgacattgcacagtccgttttttgccagttcaatgcaacgtctcatgtatttttcttcttccattttggtgctcttcgctatattattcttacttttgcactccgaaatcgtaaaatatgaaccgcatcactgcttacattcgtcagtcactacaggatatttatccgccggaagaggtcaaagctctttcgatgttgatctgttgcgacatgttgggggtggatgcgcttgatatttacatgggcaaagatataattttatctgcatgcaaacagcgtgaattagaaaacattatattccgtttgcagaaaaatgagccaatacagtacattcggggatatgctgagttctgtggaaggaactttcgggtagctcccggcgtgctgatccctcgtccggagactgccgaactggtggacctgattgtaaaggagaatccggatgctcgtcgcctattagatataggtacaggaagcggatgtatcgccatctctctggataaaaatctgccggatgcgaaagtggatgcctgggatatttcggaagaagcgttggctattgcccgtaaaaataatgaagagttggatgctcaggtcaccttccgtcgacaggatgttttttctgctgacggaatacagggggcatcttacgatataattgtcagcaatccgccctatgtgacggaaactgaaaaaacagagatggaagccaatgtgcttgactgggagccggaacttgccctgtttgttcctgatgaagaccctctgcgtttctatcgccggattgcggaactgggacgagaactacttcgtccgggtggcaaactctattttgaaatcaatcaggcatacggacaagacatgatacgcatgatagaaatgaaccaatatcgggacgttcgtgttataaaagacatatttggaaaagatagaatacttacagctaaccgatgagtgcacaattaacagatgaagaggcgttgaatcgtgttgcctcttattgctccgctgcagaacattgccgggcagaagtaaatgagaaattacagcgttggggtatagcctatgagaccatagcgcgtatccttgaacggctggaaaccgaaaagtatattgatgacgagcgctattgccgtgcttttgtgaacgataagtttcgttttgccaaatggggtaaaatgaaaatagcacagggactctacatgaagaagattccttccgatgtggcatggcgtcatctgaacgaaattgatgaagaggaatatctctccatcctgcgtgacttgctggcttccaaacggaaaagcattcatgcgaaagatgattatgaactgaacggaaagctgatgcgatttgcggtgagccgtggttttgaactcaaagatatacgtcgttgtatcgaaattccggaggaagaggaacaattcagttaaaaaataaacggattcttctttctattctcgttcaatttctgtacttttgcggcaaataattaatagttagtttagttatgaaaaacttagagagactatttgcggagaaacttttgaagattaaggctattaaacttcaacccgctaacccttttacatgggcttctggatggaaatcccccttttactgtgacaaccgtaaaactctgtcctatccttctcttcgtaattttgtgaagattgagattacacgtctgatattggaacgattcggacaggtggatgcgattgcaggtgtggctacaggtgctatccctcagggagcattagtggctgacgcgttgaatctgccgttcgtgtatgttcgttctaccccgaaagaccacggattggaaaacctgattgaaggagaacttcgtccgggtatgaaagtcgtagtggttgaagatttgatttctacaggtggtagtagtttgaaggctgtggaagcaattcgtcgcgatggttgtgaagtgatcggtatggtagctgcctatacgtatggctttcccgttgccgaggaagcattcaagaatgctaaagtacctttggtgacgttgaccaattacgaagcagtacttgatgtagcacttcgtaccggttatatcgaagaagaagatattgcgacattgaacgattggcgtaaagacccggctcattgggatgcagggaaataatattgtattatttgatcggaaattttagtaagaaagaaccattcggacaatatctgttcggatagttctttctttgattttatacgaataaagaattatggctaattttgaaagtagtgtaaaggtaataccttacagtcaggaacgtgtgtatgccaagctgtcggacttgagcaacctggaatcagtgaaaggccgtttaccggaagataaaatacaggacttgagttttgattcggatacactgagctttagcgtttcgcctatcggtcagctgacgttgcagattgttgagcgtgaaccttgcaaatgtattaaactggcaactaccaactctccgctaccttttaatatgtggattcagctagtctcaacagcagaggaagagtgcaagttgaaagtgactatcagtatggatatcaatccgtttatgaaagcgatggtacagaaacctcttcaggatggtctggagaagatggttgagatgctgtcgatgattaactattaaacaggtaataagtaataaataataggtaatacccgcggagtatcaacgtaactacgattattacctattacttactacttattacctaatacttaaatattatggcgcagaaactttgggaaaaatccgtgcaggtaaataaagacatcgaacgttttacggtgggacgtgatcgtgagatggatctttatctggctaaacatgatgtactcggttctatggctcatattacgatgctcgaaagtatcggtctgttgaccaaggaagaactggaacagttgttggctgagttgaagactatttatgcttcggtcgaaagaggtgagtttataatagaagaaggagtagaggatgtgcattcgcaggtagaattgatgctgacccgccgtttgggagatgtcggtaagaagattcacagtggtcgttcacggaatgatcaggttttgctggacctcaaactctttacccgtacacagattcgcgagatcgcggaagcggtggaacaactctttcatgtgttgattcttcagagtgagcgatataaaaatgtcctgatgccgggatatacccatttgcagattgcgatgccttcatcctttggattgtggttcggtgcttatgccgaaagcctggtggatgatatgcagttcctacaagcggctttcaggatgtgcaatcgcaatcctttgggctctgcagcaggatatggctcctctttcccgttgaaccggacgatgacaaccgatttgttaggttttgattcgctgaattataatgtcgtttatgcgcagatgggacgtggcaagttggagcgtaatgttgcttttgcattggctaccattgccggaacgatctccaagctggcttttgatgcttgtatgttcaatagtcagaacttcggtttcgtgaagctgccggatgattgtactaccggttcgagcatcatgcctcataagaagaatccggatgtgttcgaactgacacgtgctaaatgtaataaactgcagtctcttcctcagcagataatgatgatagcaaacaatctgccatccggttacttccgtgacttacagattattaaagaggttttccttcccgcttttcaggaactgaaggactgcttgcagatgacgacttatatcatgaatgagattaaggtgaatgaacatatccttgatgatgataaatatctgtttattttcagtgtcgaggaagtgaatcgactggctcgtgaaggtatgcctttccgtgatgcgtataagaaagtcggtcttgatatagaagccggaaaatttactcatgacaaacaggtgcatcatacacacgaaggaagtatcggtaatctttgtaatgatgaaatctccgcattaatgcaacaagtggtcgatggcttcaatttctgtggaatggagcaggctgagaaagcattattagggcgataaaatattttctgccaaacttttttgatcgaaagtttggcagaaacaaggaaactcattatctttgcacccgttgaaaaaatgcggaaatagctcagttggtagagcataaccttgccaaggttagggtcgcgagttcgagtctcgttttccgctctctttgaaaggatgctcgaatggtggaatggtagacacgaaggacttaaaatcctttggccattgcggctgtgcgggttcaagtcccgcttcgagtacgagtattcctgattaaaagctctgtaaatcattgatttacggagctttttgtgtgtttctaccgccatatgccctgctgataaaggggcaattacaacctcaccgaatatatttgataattattgtcattgaatttatttttaatgttaaaaaagtatgtgatagatctactgagatttaatttcataccttgatatattatttagatagtatgttgatattttgtttggtgaataccttcatatatgctggttgttttacaatatttcttatgcattaaatagatgttaaatccagtcttttccttcgaactatctttttttgtgtgatgttgtttattttgagaacgttttgatacaatgtaaaagatattgcgcaattgaacagggtgaatagtatcttattataaatcgggagtaaactcttttgggaatgtttttgtgttttccatgtttttacgtttttctccctgctgtaagtgtggaggaggatgcaagggagtttacataattcaatatattatggacttacattcaggattgccctattgggttgttaaaaattcattgttagattactttcatcccttggaggatgatttttcaacagatattgtagttgtggggtctggtataacgggtgctttgatggtacacgagctttgtagtgccggtttaagatgttgcatggttgacaaacgaagcattgcaactggaagttccattgcaagtaccgctttactgcaatatgaaattgatgttcctctttgtgaaatggcagaaattattggagaggataatgctgtttctgcatatcgcgcatctttggcatcaattgctgatattgaaaaggtattaaaggaaacaggagtagatgctgattttgaaaaacgaccaagtcttttttatgctagtattccaaaggatatagaattaattgaaaaagaatatgtgatacgaaagaagcacaatttgccggttcgtctgctggaaaaagaggagataaaaaaactgtataatatagaggttccaggcaatgcactgttaaaccgagtatcggcgcagatggatgcttacaaagcggctactggtcttttgctctaccatatgaaaaaagatggactggaaatttttactcataccggtgtaacagaatgtgttgaaatgcctgaaggatatattatagaaacagatagagggcataaaatagagtgtaaatatgtgatcatcgcagccggatttgaagcagggaagtttttatctcgggaaattatggatttgacttcaacttatgcacttgtgtcgcatccggtagattctaaagatttgtggcctgaacagtgtttaatttgggaaacagctgagccatatttgtatatacggactacaaggggaaatcgtatcattgtcggtggtgaagatgaaaagttcagtgatccggagcgccgtgatgcgttactcagaaagaaaactcttgtattagaaaagaaatttaggagattatttccaagtattccttttaaaacagaaatggcgtggtgtggcacttttagtacaacaaaagatgggttaccctttatcggtaattgtccagataaggacaggatgttttttgatttgggatatggtggcaacggcataacctttagtatgattggagcacagattatctgcaagaagttgcaaggtatagatgatgaacgcggtaggattttcggttatgagagaattgaaaaatattggtaatttgcagagagtaaaagtcaatagtaactcaaatctccttcttgaaggagggaaattttgggagagttgctattgacttttgctgtactctcccatgtttagaattatattcatataaatattgctttctgatgtagctaatatttttgaactccagtacccagccattgcggcattcgtgccttgccgtagaaataatagaacagcaatcctatccagctggtaagaacgattaagataatagctatcagccgtctttctattggtgcatggatacgccatatttccagtgcggctttgatagtcagtactaatccaacaatccatattacaaatccaaccatagcttattaatatgtaagaagttactatttatagaatgatatacgattaagaatcagtcaagttttttacttacatcttttttcacttcgttatatccttccttgatttctttcttggttttctctgcgctgttttgaacgtcttttttggtgtctttccacgcatcttttacggcatcagcaccatcttcgattttatcggatactttgtccactgcatcattgacgttttctttcactttttcaacttgttgtttcgctttatcctgttcttttttattacgacaggacgtgaaggatattatagttgtaactacaaaaatcgcaaataataattttttcatattcttttaaattaaaattgtaaagtcactttgagaataaattggtggattcttcaggcagattcctgtctgcctgaagaatgacacaaacttaacgattctgaatgcctatttcttttcagtttttttgcttgaagtcgaagacttgcactctttagcttgggcggtctttttagtgccctttgcctcttcctgtttcttttcagttttcttgttcataattcaaaagttttagttaataatttaggtttattcagaaacactctagtgttcttaattggtttactagaatctgtttcatttttttgcatcagcagctattgtatgcattttgcctttaaggtcatctgccttttcagctaggtcgaaagttttgtctgcaactttatcggctacggcagcacctgtatccaatactttttcctttgcagtatctaacatttcttcggcttgcccacttattttatgaaaggcatcacatacttttttctttagttttttggctttagaagttcgtgaaaaacgataaacgagggcgccaatgaccgatcctataccaagaccgagccataaatcagaagttctattttccataattaagttggttttagatagttaaaaatagagtttggtaataagtaagaaactgtatgtaagttaagttcttaaagtcacatacttattagtgggtttatatgtaaatatatagatatataattagtattttataaaggaaaaatattttgcttgttgaatggaaaaatatttattcatatcgctagaatattcttctttacagtcagcttgtttgctgtctcatacttgataaacaataaattattgttcctatgatagagctgactattaatctgatccataaatttgaacttatacttttcatggctgtagattttattgatgaaacaatatttaaaactcatttttttagaaaaatatgtaggtttcctctattacacttccccgatttattatattacttttgttatatcatccgaaatgtacttaagctcctactgtatgaaaaaaacacgggattaaaaaaaatagttcgaagtttcaaaatggaattaacatcattttttattttatggaaaattgaaaagaggcttatggattttaaatgcataatcgaaggaataaatatatgattgaaattgtcctaataataagatgatccctgttcgtgtatatttatgatctgatgctggaaaatcgtacaaaaaatgactaatataattttgaaagaacacttatctatttccgatgtttttattggggagtatttggggtattatgcggtatttccgatagatgagatagttgtgttttttaagtttctgtttttaacatataattattaatttattcagttgctgtttaaataatattttcatatttttgcaaatatatttttgagtgttttgtgaaaggaatgaagataattgtaaaaaatagaaaacttttagtgtttatagttcttctcattagtagtgctgtgagcaaggggcaaatttataagtacatagggttggaagacggtttgaacaaccagaaaatctaccatattcaaaaagaccgacgcggatatatgtggtttttgactcaggagggggtagatcgttatgacggtaaacacatcaagcattatactttctcggatgacagtatgaagctggactcacggatagctttgaactggctttatatggatcaggaagatgtattatgggtaatcgggcagaaaggacgtattttcaggtatgattcacaacatgataaatttgaattggcttatgtacaccctgaattgatccgaaataagtttcaagtatttcttgattatggttatctggacaagaatgatcatatttggctatgttacaaagatacaattacctggtataatattcgtactggaacaacacaacatatgccaaagcctgtcgatggtgcaatatctactattgagcaggctgatggcggtcatttttttatcggtacgggaagcggtttgttttgtgtcgggatagaaaagggagaactgaaacaaatttctgatgaagtagtaaaaagcatcgttacacctgttcacgaactgtattaccatactgtgtcaaagcaattatttgtgggtagttataaagaagggatacttatatatgatattggtaaaacccaaaaaatcactccttgttatgcaccaaacaatgtggaagttaatcagattgttgctctgaacgctgatgagttgttgatagctacgggtggaaaaggagtatataagctgaatgtaaatacttgtaagagtgaaccttatataacggctgactatagcagttataatggaatgaacggaaacaatatcaatgatatctatgtggatgaggaggagcgtatttggcttgccaattatcctactggtattaccattcgtaacaatcgttatggaagatatgatttgataaagcattctcttggcaataaccggtcgttagtgaatgatcaggtgcatgatgtgatagaagatagtgacggtgacctttggtttgcaactagtaatggaattagtttttatcagaccgatacaagagaatggtgttctttttttagttcttttgatccggtgccggatgatgagaatcatatcttcttggcgttgtgtgaagtctctcctggtgtgatatgggctggtggttttacgtctggaatttataagatagaaaagaagaaagggtttaaaataagctatctttcgcctgcggccattgcaggaatacgtcctgaccaatacatttatgacattaaaaaggattcgagcggtgatgtatggtccggtggatattatcatttgaaacgcattaatcttgagactaaaaatgttcgtttgtatccgggagtaagttccatcaccaccattctggagaaaaatgcccgtcaaatgtggattggtacaagaatgggactctatcagcttgacaagcaatccggtgtttaccggtatattgacttgcctgttgaatctccttatatatgtgcattataccagagagaagatggtatcctgtatattggtactcgtggagcaggtcttcttgtttatgatatcaataaaaagaagtttattcatcagtaccgaactgataattgtgcactgatttctgataatatttatacgattattccgcgtcaggatgaaaatctcctgatgggtacggaaaatggtattacgatttattcacctaaagatcattttttccgtaactggacacgggagcagggactgatgagcgtaaattttaatgccggttctgccacaacttacagtaacagtacgcttgtctttggtggcaatgatggtgctgttaagtttccgacagacatagaaatacctgagccatattattcgcgtttgttattacgggattttatgatagcttatcatcctgtctatcctggtgatgacggatctcccttgaagaaggatattaacgagactgattgtctggaattggcctacggtcaaaatactttttcgcttgatgtggcttccataaattatgattatccttctaatattctttattcatggaaaatcgacggttatcataaagagtggacccgtccgagtcaagataaccggattgttgttagaaatctgcctcctggcagttatacattacaaattcgtactgtatctaatgaggagaagtataaaacttatgaaacaaggagtattcagatcattattacccctccggtatgggccagtatgtgggcaatggtggggtatgcaattctggtggtcttgattatgattatcatattccgtgttattatgttgcacaaacagaagaagatttctgatgagaaaacacggttctttattaatacggcccatgatatacgtacgccgctgacattgataaaagctccgctggaagaagttgtcgaaaaccatatggtgacagagaaggcattaccccatatgaagatggctctaaagaatgtgaatacattgcttcaactgacaaccaacttgataaactttgaacggatcgacgtatattcgtctactctctatgtttctgagtatgaattgaactcttatatgaatgatgtttgtgctactttccgcaaatatgctgagatgaagcgtgtcagatttgtttatgagagtaattttgattatttgaatgtgtggtttgatagtgacaaaatggggtctattttgaagaatattttgtcaaatgcgttgaagtacacgccagagaatggtagcgtgtgtatttgtgcttgcgaggaaggggatacttggagtattgaggtaaaggatacaggaattggtattccttcatctgaacagaagaaattattcagaaattgtttccggggtagtaatgtagtcaatttgaaagtgaccggaagtgggattggattgatgctggtatataaactggttaagttgcataaaggaaagatccatattcaaagtgttgaacatcagggaacatgcgtgcaaattactttcccgaagggaaatacccatttgcataaagcaaagtttatctctccaaaaacgccgaatgaacgtatggatgctgttgtactggggggaacttctgacttgccgctcttggaggcacctcagataaaaacctctttacagcgtattctggtagtggaagataatgatgatttgcgtaattatcttgtggatatgcttatggcagggtataatatccagtcctgttccaatggcaaagatgcgcttgtcattataaaggagtttaatccagatcttgttatatccgatataatgatgcctgagatgagtggagacgaactgtgctcagctatcaaaacgagtgtggaaatgtctcacattccagtcatattgctgactgcgttaggggatgagaaaaatatactcggaggactggaaatcggagcagatgcttatatcaccaaaccattcagtgtgggtatactaaaggtgactattaaaaacatattggcaaatcgtgaattgctccgtcaggtctataatagtatcgaaaataaagaaaagcatttacctgtcaattgtactaatactttggactggaaatttatagcttcagtcaaggaatgtatagagaagaatatgggagatttggactttggtgtagatgtactcagtaatcagcatcatatgagccgaacaagtttctataataaactgaaagcgctgaccggttatgctccggctgactacatccggatgatccgtttgcaacgtgcagcacaattattaaagcagaaagaatatacaataacggagattgctgaaattgtcgggttttcggatgcgaagtatttcagggaggtatttaagaagtattataatgtcagtccaagtaagtttgtgaattcggatcaggaatagagtagacgagatatcgttttataccattgttgtttcttataaacttttggagaggattataggacgctaagtttgaaaagaagaagatgtcaaaagcaagataaatgtatcatcctgcttttgacatcttcttttttaaatagattatttataataacttgttggagccgagtatgatcagcattgtatatcccaagataagtcctataattcccataataatacccaccttttccatatctttttgctgaatcattcctgtggcatgtgccagggcattaggtggtgtactaattggtaatatcattgccagcgatgatccgatggcgactccaattaataaagtctctacacctcccaatgatgacaggttttcacgcatgctgattccagcaatggcgagaatagggacgagtaatgctgcagtggctgtgtgtgaaataaagttggccatagcatagcaaatcagtccggaaccgacaatcatcagtacaggaggccatgtgctgaatgggatggcttcaatcatatgctttgccagtccggtctcttgcaaggctacgcctaatgcgaagccaccggctaccatccagagtacactccagctgatctcttccaggtcacgtttggtaataacgcctgttatacaaaaaacagctaccgggatcattgccactacattggagtttactcctgtaaatttgtcgaacatccacaatagaaccgttatagcaaaggtgatataaaccacaatggaacgccagtctttctttgcttcaccttcaatttgcagttcgatgctcttttgtttgaatggaaacagccgtaagaggataaaccaggctataaacagtacaataatggtataaggcaacataaagctcatccattctccaaaaccgatattcagatttaatccttccggatcattcaaatactttaaagcaatggcgttaggtggtgtaccgataggagttcccataccacctacattggcagcaacgggaatggccatagccaatccgattttcccttttccatctgccggaagtgcttttaatacgggagtaaggaaggtaagcatcatggccgccgtagccgtattgctaagaaacatggaaaagacagctgtaacgaggatgaatcccaatagtacatatcgtgattgtgttccgaaaggtctcagcataactcgtgccaacaatacatccagtccgcttttggttgctgcgatggcaagaataaatccgcctataaacagcatgatgataggatcggcaaagcaatgcagaatagacttatatttgactgtttgtcccaattcctccgcaggagtattttgggttaagaaccataaactactgtcggaaacggtaagtaatagtaatacgacaataagaacggaagtggtccatgccgggacagcttcgaacacccacataagtgtggcgaaaatgaaaatggaaattagtctttgttctataacggtcaacccttctattccaaaagtatcaatgggaaggaaccataaaataagagagagggtaatagctatggttaactttatacatcggggcactgtctgattctttgctaaccgtttagctttctttaagtcctgataggcttctaccaggtggaagccatgaaaaatcttgtacataatattagaatgagataaaaattaaaaaaacgtttgcaaaaataactttttattttgtatttagttagtctgacattaaagatttcttttattcaacatcgttattaaaattttatgcagatggcttgctgtattgaaaaaagtagtatttttgccgccgcttttggaaaatgcatttataaagtttccaatattcagtattattataatcaaaaaaacatgaattattcttgcagaaaaaccatcgttcctattataataggaacattactttcaggcgcctgctcgaacgatgaaccaaccgggggaaaaggccatcaacaaacttattcagtggtattaaaaggaattacggtagcaggagaagaatcttctgaagagctcaaagatgtatcggttttccagtttagtgacgggaatttatataaagaggaacagttgactcccggtaaaggcgggcagtcggagatttctgcggtcagcggatctcgactctattttctgaccggactggagattcctgccggagagaaagctaaaagtgaagaagaatttcgtaatacgattatcggtgaaggattgcatgataattctgcaccggatttcatggcggctgtagtcgaattggagagcggagtagtgacacgcagcaatgcggaggtcaatgtaattatgaaacgcggcgtggcgcgcattgatttgaacacaacagccgacagcaaaacgcagataaaggaagtcatcgtagagaatgctcctgccgagactttgccattcctcgaaaatgtccgggcgtcggacaaaacagtgagctaccgaaaggagttttcttctgcattcgatggcaagcaagagggggtattccgtctgttcgaaagcacacgtcctgtcaatatcatcttgcgtggaacctatggtgaagtccccatcaggttaaaagtcgaattaccagttgtcgaacgcaataaagtatatgaattggcagtgctcaatgtgggagctgaagtgacgggcgtttttgagatcaaaccgtgggaagaaggagaaacgattgtcggaaagcctgatacgaaccaacgtcttttgcttaatgcgtcgaaatccaggattccggaaggggtgaaagtagactatgagaataatgtactggaagtacctgctacaggtgctgatgacatgacgctggcgttcgttacagacactcgtatcgatatttcttctacagaaggtgccggtagcggaacaagtgtaggcaatatgtccgtgtcggaagaggcggaaggtatcgtgtcggcatttaatgtatcggttgcagcgcaaggcagcggtcgcttgggctatacggttttggtacatttaaaaaatgccttgttgaatggaacatatgattacgtggagatacgtgtggctccgagtgacaaacagattgaaacagtggaaatcgcaggaaatgtatggatggcatttaatgcgcgtagccgtgatctggaagatcagatttatccgttggacggggctacggtcgaagacatgtatcataagagttggataaacacggtgggtggtctgttccagtttggacgtttatatatgtacgtgccttggcaggggtataatccttccaacaatttaggtaaccagacagctgatgcaccttgggtgaatgatacacatatgccttgccctgaaggataccggataccgactggtaacgaatggcagtctctgcttcctgcagaccaagagattccgggtagatataaggcaggaaatggagaaacaattgccgctacacttcacatcggagaaggaacactgataactccgtccagtggtgtgacgggaacacagcattatgtgaagtttacttcggaagacaccggtcgcagccttattattcctttggctggctcgaagggagataagtcatcatccaataatccggctttcgggaaaagagctgtgttgtggacaaacgaacgtaacggtcttccgggcggttatgcatgggcttactggttgccgttcgaaggagccgagacagccgttattaagaaacagcggttacagatggaagcatttgcatccgtacgttgtgtaaagaaatagaggaggctgtttatgaagatgctaagaatcataatgatattactgggcgcattattgcttaccaactgttcgggcgattttgaacaggagaccggcattgttccttcccattccggacaagtgtcgtttttgtttgggttgcagcaagacgatgcgtccgtggtgcagacacgcggaagcaaaccggagcagatcactcgtatgtggtatgctattgccaatgaacgtggagagattattaagcccttatatcagaagctggaagaaaacttctcaaaattgactatcgaaggattgagtatgggggattatacagtcgtttttctggctactacgagcgaggaagaagatgaggctgtcaaagaacccgaaaaactgtccgatgactggttgataaatcatgcggaaaatgcgccgttagatgcggtttacttttataagaaaatagaattgcatatcggcagagatcaggcttcggtgtcgcatacagtggtcttggagcgttctgtagggagagtggatgtcgatttgaatgtatcgtccgattatatgtggagattcattcgtaaaatcgatgtaactttcgacgatgccgaaggaatatatgccgctcttggtgcagacgggaaatattccggaaccaaaaagatagaatcttatgacattaccgggaaatactcgttttactcattgcccggcacaaaagcattatccggatttgtgacgattgagtcagatcgcagtgacggaactcagtttgtccgtaaataccgtttcacggattgtaagattgaggcaggccgtgtatctcatattagtattgattatctgcatccggaaaatcaggatggttcactttatgttcgcaaagaggacttctttcggtttcgcgcggatacgatgtttttggccagtgagccacgtgaggtcttttatgacagtcgccgtcgttctttttatgcgaatgctccgttgcaggtttccatttcagacgaacatcagttgcttgtcaagttcttttctcctgtaggtattcaggatgtgaagattatgtgccgttttaataaatttagcatggagttcttcgaactggcacatttcgagcagatttatccgtttatggaagcgtcattccccttgccggttgtagattcggaacggacattcactacaagtagtggacgaaagatagtggtgcctgcacagcccggactttccaatgacgatgtgacgcttgttattcgtacagaagacccgtttatgaagaaaatagaacagatagacagtcgttggtttatacgtttttcttcttattcggctgacaatggccatgcgtattggcgtcatatgaatccgttattgtgccgtcatggagtggcgttggctgtcaatatggctttcatgttctcttccgaagagtttaatatggaaatgaacaaatacgaaggtttgttgaaagacaatggaggaaatccgatcaatctggatgcgttgcgtcaaagaatccgtaatcatggcgggcttgtgctgggttgtgttgccggtgtcggcggattaggtggaggcaatacatacggcttggctaattattgttataccggtgtttattttgatgcgactcctccggatgcccatccgcataattatccccgtcaggccatgtttcatgaatacgggcattgccttgggtataaccatagcagtacgatgacatatggtgaccaatggacggtgttgtgtgcaacggtttttgtgaacatgggaaagaatggcaaattgccggtatgttcgaaagagataatagcacagttaccgatgtaatctgaaatctttttccttcttgcttattgcaagtacaagaaaagccccgaaccatcacggtccagggcttttttcatcattataaacatgtatataagcaatactaaatttaaacacgtaagacatcacgcatacaaacgacgctaactgcccattatgggctgtcaacatttgcaaatatatatatttatagattaagaaagaatatcgcatcgtcacgagtgaatattctgagtaaaatgatattaaatcagtagtaatttcaaatggttccgccatcacaacgaaacgacatttgtaataatttcaatattaaacatgtctaactttgtactttgacaaactttcaattatgactaagactgcaaagatatggcttttttaataaatatgcaataattataatgtcgtaaattcacttctgtcattcgtaagggggaggctgttgagcggatattaaatcggaaaaattgtctgtcgttgataaatgtgagatttataggtatatggattgtgataggattttgtatgaaaagatgattggtttagtgcagggctatatatctgcttactcttctcgtttataatttgaatattaatattgggacttctatttttcttgtttttggggggtgtataaataatacattaaaaatggaacatagaatgccaagaatggcacttgtggtagttgttttaaatcttttactttgcgtgattttatgtgataaaaaagaatttataattaactatgaagattatgaagaaaagattgttgtatttgtttatgcttattagttcggtgagtctatttatgagttgtagtgacgatgacgatgtgaaatatccggttgacagtgaacttgcaggtgcatataaaggaacgatggatgtatattatgtgggagtatctactcctattgtttctgatatggttcagaaggtttatatctcaaaggcttcggatactgctgtaaaactggaactgagaaactttactattaccgtagcaggtgctgagcttcttattggtgacattactgtggataattgtgctttggcaaaaagtggtgatgcttataagttctccggcaatcagacattaagtcttgttgtgggatcatgcaatacatccgttttgggtacagttggtaagaatgctgtagatatggttattgatgtagatgtagaaggcggaatgaaagttaaggtcaattataaaggtactaaactgtcaggaagtgaaaacacggaggctaaaataaccgattttactattgatgacgaagttataacagtagcaccggttattgatgatgcaaagagtgccattacgtttaaagttaatgatgaggctactgaggaagacttgaaagccttggtaccagtcattgctgtttcagaaaaggctaccgtaactccggcaagtggtgttgctcaggacttctccggaggaaaaagtgttgtttatactgtagttgctgaagatggaacatcaagaaagtatactgcttctattgaaggtgttcagaatatcatgaaatattctttggatgaatggtctgaatttgatgcaggtaatagttatgaaaattattggactccggagcctgcaggattcctggctacttccaatggtggtgccaaaatgttgaatggatcatcttcggcagtaaaagtaggctatcctgtgatggaagaatctgaaggatttagtggtaaggctgccaaattggtgacattggattctagagcacatgctttaggcagtatggcacctatcacttccggctctttatttacgggtacgttcagtcttaatatgcttgctcctttgaaatcaaccaaatttggtattgcttatgacaaggagcctaaattattaaaaggcgtatataaatataaagcaggaacgaactatatagatggttctgtcaaaccagcgcaggaggggcttaacattatcgacgaatgttctattgctgcggtattgtacgaggcaaaagatgcagccggcaaagatgtgacactcacaggagtagatattaatacttcagaatatcgtgtggcagaagctcgcttgaaagatggtacggataaagatgaatggactacatttgaacttgcatttgagtatttgccggagaaatcttatgatagtactaaagagtataagttagccattatatgttcttccagtaaggaaggtgataagttcaaaggcgcagctaacagtacgctgatcgttgatgaattggaggttattggcgagtaatgagatgtatagctagaataataggttagttatatgaaaatttgaaaactataatatcttgaatatcgaaaaaggggggacttgaaatccctcctttttgggtatatatttgttgagtatgctgtaaatatgaaccttaaaaagtagataaaaacagcttttttgcaatatgatcttaaaaatagatcataaaatacaaagaatggaccttgtgataattaatataaatatgttactttgtacccgattttgcgatcaaatagattattaactaaataagagaattatgaaaaagagtttgttgtatttgtttatgcttgtttgttcagtcagcttgttttcaagttgtggtgatgacgatgatgttaaataccctgttgatagtgagttagctggtgcatataaaggaaagatggatgtatattatgtaggtgtaagtactcctattgcttctgatatggttcagaaagtttatatatcaaaagcttctgatactgcaattaagttggaattaaagaattttgttataaatgtagcaggtactgatattactatcggtgatattgctgtggataattgcgctttaaaacaggatggtgaagctttccagttttcaggaagtcaaactttagaattggttgttggttcatgtaatacttctgtttcaggtacgatcggtaatggaaccattgatatggttattaatgttgatgtagctggcggaggaatgaaagtgaaagttaattataggggtagtagattatctggtaatgaaagtgtagaagctaaaataaccagttttacctttgatagtgaattggtaacaagccaaccagtgattgatgaggagaataaaactataacatttaaggttagtgaggatgctactcctgaagaactgaaaactttagctcctactattacagtttctgataaagcactgttactcccggctctggtgtagctcaaaattttgcaggaaatgttgtttatacagttgttgctgaagatggaactactaatcaatatactgtttctatcgctgctaagacaagtgttttgaagttttcatttgaagaatgggaaaatgttccaggtagtctttgggctaatgaatatgataaacctcttcctacagatgtgcttgcaactagtgctgagggcgctgccatgctgaaacttatgggagttacaactatgcctgtttacaagacagatgataagaaagaaggtgagtatgccataaagctagtgactatggatacaagtgctaaagctaatgctttagttccggcgattacttcaggatctgtatttactggtaaattcgatatggattttcttgaacaggggaaattatattgcacaagatttggtgttttatatgataaaaaaccagtcgttttcaagggatggtataagtatactcctggggagaagtttattgatggtacagatgttaataatattgtagaggttaaggatcggatagatgagtgtgctattcaagctgtattatataaagttgatactgatgatgaagttctgactggttttgatatcaacacttcagagaaacgtgtcgctgtggctgctttatctgataaaactgctaaagtagattatacttacttcgaaataccttttgaatttttgaaagattatgaagaaggagcaaaatataaattggccattgtttgttcttcaagtaaagaaggtgatttgtttaaaggtgctggcggaagtaccttaattcttgatgaactagaagttatgggagaataatttatcaatgattaaaaaaggcgagaaacttttagtttctcgccttttttaatagctataatgagattaatgtaaagattgttttttattagaatgcatacccgaatcctacatttaaataaataggatacatagcaaatgaaatcgtatcaaaatccttcttaaagatatcgttcaatccccatgttaaatcagcatacacatttaaatgtttgaatgctctccactcaccgcctaattgcaatccccattggaatttacgcagattgtcagagaaatcataagtagcaatgctttcaccagtaaaatctactcgcgaacctgtctgatccggagtacgcaagtgaccttcatatacatgtccggagaaatttctttcaataagataagatacatacggacctgctgagactttccaacgtttgcttactttatagttggcaactactgggatagtcagataagagtttttgactttagtctttacgccaccggtccataagccttgtaactctccgccgttggtgttgataatcttcattccatagttctttactgtagcttctgtggtcatattcttgttttcaagtcgtacccctacagtcattccccatttcgtgtcaaaccatttagttgcgtttccttcaattgaaatggcgaggccaccaggggcatagctatctattttacgaatttcttcaggtagaggcaatggagaagttcctccaatactgaaacctgccttgattccatattcccatccgtgtaagtacgaccagatgataccttgatttctttcttcttgcgcctgcgctgaaagtgtacttactaatagtagtacagctataatattgagtaatttatatcttttcattttcttgtttttttagtcttcgcaaataagttctacttcatcgacatacagtgtactgcctactgctcccttaaaataagcaccgtctacactggacgaaagcactatacctaatttgtattttccattctttaatttggtatcatcaattactcgtccttttaccggttcgaaaggaatttcaaaatcagtccattgatctgattcaacaacatcttccggtttaattcgcgctaatgatactaacttatctgaagtaaatacatcatcaccattaagcatgacagaattgttctcagcttcatacataacagcataaatatcacatttgtctcttacaccctcttgtggttttccttctacggaatatacatctcctgctttaaatttataatgtcctttgagcgttttagggcgtttatagaactggaaaccgaaattagtggcttttctaggatctgttaatgcatttcctacctcaaatgttccgataaataagttaccggcagcaatatacatctttaccattgctccaaaactaccggtatcacgagtttccaatttaactcctttacctctgaaaccattggctacctgtacagttgggtaatctgttttggagtttgccatacctgtcaatttaaaacccggattaccacttgaccattgtaatactttagatatttcttgtgaagtgcccggctggaattcataaaagatatcgtagtcattggaaggtaataactcttcaaagttgaaagaagtaggtaattctgctaaaacaaccttgacggtataaacaggtttccattgaccgtcttctgatgtgacagtgaatttccgggaatgtgtctcttcactaaagtcatatgtggcttctgtatctccagcaacttgatcatttatttttatagtggctccttccggaattacaaattctaacttttgtttggacaagtcagctcccttgtttacatatacattgatcagctttgaatcagcattgatgtttgctaattgtacatcatcacctgtacaagcatcaatggctgcttctgagttcagtgcttcatcctgtatgcaggaagttgcagcacaagctagtatgaaacaggctattaaagtcttaattttcatgcggtttaatctttttagttactaattcagtctctttatataaaactcgggtgcaaagttaagtttctttttgaaatctagcgctctgttagtgaggtaattcaataaaattagtgccttttataaaaatagtgtggactaaaagatgaaaaaggcttttgcttagtttactaataattcattccaaaataccaaaatgggatagatcgaatgggtgctatattcgtgctcgtactctttaaataacttgttgaagttttcgtataagcaattcatagctgaagtgcatttatctgcaatgatgcgataattgcacaacaaaagtgcagtattatgcatatttctgcacttttgttgtgcagagaattatcaaggattgctcaatagtaatttagcatcacttttgctctcatgctctaacaaactgtctgtatccctttattcatcgtggttttcggtgtggtagcaactgtggtagcaggtatgagagcaaatgcttgctctcacttttccaaatccaatctctaacctttgtagtatcttcgttttattcctgtaattccaatgtcaatttaggataagacaactaaattagtttcctcgtcttgaaactatagtttcagcgaagagaaaccatagttccaaaggcttgaaaccatagttccaaaggcttgaaactttagttccaacagcttggaatcattagttcaagcgtttgaaactttctgaaacatctgtcgattggattcactttgaccgtatgtttggattgactcgaccatgttagttatttcaattgaccagttcttttaggagaagcattgaatcatttattggctaataatgtatggggtatcagtcattaatagctgagatgtcagatattaacatcctgtaaatcaaaagatagcaatgtagaaacgatactagtcaggacgaaacagagtgagagcaaccgtttgctctcatacctgccaccacagttgctaccacaccgaaaactacgatgaataaagggatacagacagtttgttagggcatgagagcaaaactgctgtcaaattactatggaggctattgtggaaattctgattaataaatctacagatattccatacttatatttgaaaaatagtatctttgcagtgactaacattttataatgggacgcagggaatcctgcttttgataagttgcaggcattttttgcttgtagctttcctcataggcggtttcgtacccccgtggggagtatgtaatgtacctccagcgtcctaagatgtgttagtcaacgggaaaggcgaaaccgttcttttttgcccctttattaaacttttatcttatggatactgaaaacgctttgactaacgcgaaagaaagtcccaatgaaattttttttgaagaagaagcccgtctatgggcagaggtgtatggcaagcaatctgataagccggaccttgagtctcttcaacgtatgctggagaatatgaaccatttgttgcttagcttagaacttccgtgggaacgctttattcctatcttataccgaagttttgccctttatatgcgtcgtccggacgaaaatacaaataatcggaaagcctaccaactgtctgcccaacttatggactctgtcgtttacttgtcacagaatactaacttgattcatcacatacaccttttctgtaatatgcagattgccgctcttgaaaagctaaagaatgaaaaagtagaaattgagcaaactgaagattaaacaaacagaaagtcaaccaatctaaaggttacttcgttttaaaagaatcatacaaagactgaaaagccgagtgcgatctcccatcgtacccggctttaatcttatatgtttaacctaaaacctatgaaacttttcttttattaatcacacgcattgctgctgtataatattcgcatggaacagaaatgagtatactgttcaatccattgtctttcattgatgcctcgatatacgctgctttcaataaactctttacgctggctacttcccagggactaccagcaaaaacattgacctgagaaacctttctacttgtaatcatattctttttgtgttttaattgttatggctgcaaatataggaagttggatttatagattagagcaattttgagtcataatagtatagaaatgatgcaatgatctgattttagcataaattggtcagtttttagcattggaaaaaagtggagagaaaggagtgaaagctatatgctagtcgtcagccttctgatgatttaccggcttatgtcccattttctcttcaaaaagttcttttattcaattaaaatatatttctttgcaatcattaaagacctttggatatacttaaactatacgcataagcgccattaatatagatcgaaatgactgcaattaattttaattcgatatatactacctattataggagagcattcctgtttaccttatcatacgtccataatgatttggtagctgaagatattgtatcggaagcaatcatttatttgtgggaattaagtaaaaaacaggaaattccgagtatcgaagctgtattaatcacttatatacgtagcaagtcactcaattacctgaaacatttgcaggttcaggagaacgtctaccaaaacctgacagataagggacaacgggaattggaaatccgtatttcaaccttggaagcctgtgatccgaaggaagttatgtccgaagaattacgctcaaaggtgaaaacattgttggctggtatgccggaaaagacgcgcattgcatttatatccgatcgtctggatggaaaatctcataaagaaatagctgaagaattgggtatcagtgtcaaaggagtggagtatcatataagcaaagctgtgaagctgctgcgtgataatctgaaagagtatgctcctttcctgatattttttatttgatgatcttgaaaatatctttttctcctctttttttaataacagcaaaaaaagttgtatttctcactagggattatttttagtgagtggtattctatatgaaagggggagcaaatatactcctgtttattacttataaagtaactcaacttatagtatgaatcagaatttacttttaaaatatatatccggaaaagcctctcaaagggagaaagaagaagttgcagcatggattgatgccgatgccgctaatctcaaagaatttatgtcactccgcaaaagttatgatgcacttgtttggcaggatgcggatgagttgaaaacggggcgtgacaagctgctttcactacgcacttttacgatgaaggcgatgcggattgcggctatatttgttttggctttcggattaagttatatactgatacaaactctgcaaaaggaaaatgtagaaatgcagaccgtatatgtgcctgccggacaacgtacgcaagtgacgcttgctgacggaacaatggtatgggtaaacggaaaaagtacgctgacttttcccagtcagttcgcttcccgtacccgtaaagtggaactggacggggaggcctatttcgaagttcagaaagacccggagaaacagttcattgtttccacagcccatcagtctgcgattaaagtgttgggcacaaagttcaatgtaaaggcgtatagggattccgaagagattactaccactctgatagaagggaaagtgcatttcgaatttaataataccgcacagaagcctcagtacattactatggcacccggtcagaagctgatctattattcgcagagtggaaaaacggagctctatactacttccggtgagggagaactggcatggaaggatggtattatcgtctttaagcagacatctttgcaggatgctctggagattttggcagacagatatgatgtggaatttatcgttcgacgcaatgtgcccgatgatgacctgttctccgggacattcacgagcaggagcctggagcagatactgaattatatagaagcttcttcgaaaatacgctggcgttatctgaacagtgtacaaggaagtaaagagaagatgaagatagaaatttttatttagtgttattaataaccttatttcaaaaaagcttattgccatgaaaaacaaagacccttgaaactaaaaaagatacgggatgatattggtcgtatcttcccgtattgagcccagtaatcgtgaatctacttgtttcccgacaagtataactactagttttttaattaaactcgttacaaatttatgcaaaattattgtatcgtccaatttcttggaggattaaaccttcttaggcggtcttcaaggaaaatatcactatctatgaagttactatttatactcattgtctgctcattcggactggcatatgcgtccgatggatatgcgcaaaagacttccatcacattgaaggcaaacgattgtaccatagaggaagtgcttcacaaaatcgaacttgagtccggattcggcttttttgtaaacagtaagaatctcgatttgaaacgcaaagtgtcggtgtcagtgtctaataagaatatattccaggttctggagcaagtttttaaaggtgtgggcatcgaatataaagttttggataataaaatagtactggctgcaaaagaaaaagacgttgcacagcagagaaaagaaagacttattgccggcacggtaaaagataagaatggagagccgttgattggtgtctctatccgggagaagagttccggtgagggaaccatcaccgatatggatggaaactataagctttccacttcatcggcgaatcctgttcttgtattttcctatgtaggttatcagtcaaaagaagtacccgtaaaaggaaatgttgccaatgtggtgctagaggatgcgacgcaggaactgaatgaggtggtagtgacggcattgggtatcaaacgctcggagaaggcattgtcatacaacgtgcagcagctgagcggtgatgaactgactactgtgaaagatgcgaacttcatctcttctctgaatggtaaggtggccggtgttaatattaattcgtccaataccacgggaggtgcttcgcgtgtcgtgatgcgtggtgtcaaatctatcacttcttccaatctggcgctttatgtgatcgacggtgtaccgatgtataacatgatgaatggaggtggcggtggtatctatgaccagcagggtacggatggcgctgccgacattaacccggaagacatcgaatctatctctatgctgaccggaccttctgccgcagctctgtatggtaatgctgccgctgccggtgttgtgctgataaccaccaagaaggggtctgcggacaagacttctgtcacggtctccaataatactactttctcgaaggtgtcaatgatgcctgagatgcagagcaaatatggtaacctgcccaacagcctggatagctggggaccgattgtaaacagtgactacgatccgcgtgacttcttccagaccggagcgaatgtcattaactcatttgctttgtcaaccggtaacaagaagaatcaggcgtatttgtcggcttctactaccaacaccaccaatatattgcccaacagtggatacaaccgctataatttcactgtccgtaacacgaccagtttcctgaaagacaagatgacactcgatgccggtgccagttatattcttcagaatgacaagaatatgatgtcgcagggttattactataatcctctgccgggactttaccgtttccctcgtagtgagaatttcgatgatgtacgtatgttcgaacgttataattccggtatggacctgatggagcaatactggccttacggcggtacttcaagtggtcttgccaacccctactggatacagaatcgccagttgcgggagaataagaagacccgttatatgatcaacgcttccctcaaatatcagttgttcgactggctggatgtggtaggacgtgtgaaaatagataattatgataatcgtagtacttataaggcatacgcttctaccggcacactggtgtcgggtgaccgtggaacgtacagtgacacctctacacaatcaaagaacacgtatgcggatgcgattgctacactgaataagagttttaacgactggtcggtcaatgtcaaccttggtgtgtcactgagtgacagccgttatgaaatgatcggatatgaaggcggattgaaacttatcaatttctttgccgtccacaatatcgatttcaataaagcatggaaagcaaaacagtccggctggcatgatcagacacgcgctatctttgccaatgcggaaattggttggaaatcgatgatctatctgactgctaccggacgtaacgactgggattcaagactggctttctccgattacaagtctttcttctacccgtcaataggactttccgccattctgacgagtatgtttaatgctcctgattggctgacatacctgaaagttcgcggttcgtacactgaggtaggtaactcttacggccgcttcatgactaccgttacttacccttacgatgaacagacacagagctggaccagtacctcttcttatccgaacacgaaactgaaaccggaacgtaccaagtcatgggaagtaggtttggacgcacgtatcctcaatgacatcagtcttaacttgacttattatcgttccaatacttataatcagacattctatgcggacttgtcgctttcttcgggatattctaatattcctatccaaagtggaaacatcatgaacgaaggtctggaaatgtcattgggttataacaagcagtggaaagatttctctttcaatacgaactatacattgacatggaataagaaccgggtaaaacggttggctgacggtgtgtataactatgccaccggacaacctatccagatgccggaactgtctccgcttacttatggacatacggatgcccgcctgattttgcgtgtcggaggatcaatgggagacgtatacggacaacgcttgctcaaacgtgacttgaatggctacattcttaatgaagaaggtgtcggactggctatggagaacaaagaaacctacttaggttctattctgcctaagatgaatatgggctggagtttaggattcggttataagggagttaatcttggcatgactttcaccggacgtttcggaggtattgttatcagtgagacgcagtccgtacttgacgctgccggtgtttccaaagtcagcgcggacgtacgtgacgcaggaggcgtgcagattaatcagagcaaagtctctgcacagacttactatcagaccattcagggaactgcggcttactacacgtatagcgctaccaatgtacgactcggcgaactttcacttagctatacattgcctaaaaaatggtttgacaataaggtcggaatgactgttgggctggtaggaaagaatttatggatgatttattgcaaggctcctttcgatccggaactgaccacttcagctgcatctaacttctatcagggatttgatgcctatatgcttccgagtacaagaaatttcggattcaatgttaaatttcagttttaaataataaataggtatgaacaagataataaaatatatcggagcaagcgcagtcgtatgtatgatggcggggtgtactactaactttgaagattttaataccaacccttatcagccttcaaaagtaccggcaagtaacttactgtctacgatgtttaacgtgtatgcttgtccgcaacagaatgcttgtcaggagattaattgtatgtgggccagctttagcggtcaagtgactgcgacagctaactggagctttggaaagaatatctttgcttattataatgcgtccgaagggcacaatgacagttcatggggaagactctacggctatatctatccttctttctttctggtcgagaactctacggaaaagaaaggtgtcatttatgccatggctcagttaacccgtgtttatggtatgcagttgctcgcatctttgcaaggtcccattccttacacacagatgaaggccggcgaaacggaagccccttatgataatgagcagactgtatggcatgccatgtttgacgatctggataatgcgatcaccattctgaagtcggcggcaacgttcggcgtaaatcaagatttggctgtggtagaccagttctataaaggtgactgctcgaagtggctgaagtttgccaatacgctgaaacttcggatggctatccgcatctcgggagtagaaccggaatatgctcagaccaaggctcaggaagctgtacttggaggtgtgatggaaagtgtgggcgacagttcttatgatacgactaatggcggaatcaatgaaaatggatatgctattgtcagcggatggcccgaagtaagagccaatgcctgcctcgtgtcgtacatgaacggatataacgatcctcgccgtcctgcttattttactccgcagactcagactgctgccggtgggtatgtaggtgtccgttcgggttcggcagaaatacctgaacctacggtatacgccaactatagcaaactctttatcgctaccgacaaaacattgccacaaccggtaatgtacgctgccgaagctgctttcctgcgtgcggaaggagcactgaaaggctggaatatgggtggagatgccaagactttctatgaaaagggagttcgattgtcttttgaggaatttggggtatcgggtgccgatgattatttggctgacgctacatctataccgggaaattatgtggataatttaattgccggacataccggaaacaattatacgaaccagtcgtccattacgatcaagtgggaggatggagctgatgacgcgaagaaactggaaagagtacttacccagaaatggattgcctgttatcccgacccgatgaacggatgggcagatttccgtcggacaggctatcctagaatcttcccggcaactgaatctatgaatgccgattgtaatacggggcgcggacaacgccgtcttcgttttacacgaagtgaatacaataacaataaggcgaatgtggaagcggccgtcagtatgcttagcaatggaaaagattctaatggaactgatctttggtgggcaatgaaagaaaatggtacttattaatagcttaaattaggaataacaatatgaagaaattattatatatcatatttggagtaatgggtgcactgatgtttatacagtgcagcgactggactgaaatggaaccgaagttcaccgaaccggtgaatatcaatggcgaagactattataaggcactgagagagtataagaaatccgatcatccgattgttttcggctggtacagtgaatggaccggaaccggaacgaatatgaacaaccagttgagaggtattcccgattcaatggatatcgtctctctttggggaggggctttcaacctgactgaagcacaaaaaagtgaccttaaggaagtgagagagaagaaaggtctcagagttttgtattgtcagcatatcacagatataggcagaagtcatacgcctgcttctgttgagaatgatttcatcgtggatggcgtacagtacaactctaaggatgaagcgatggctgcttattgggggtggtatggcaattatggtgacacttcggaagaaggacaagaaaaagctatccgtaaatatgcgcgggtgattattgattcaatcaataagtataactatgatggattcgatatcgactttgaaccgaattttggctattccggaaatctgagtggaaattcggaccgtatgcatatttttttggatgaattatcgaaagaattcggaccgaaatcgggaactggacgtatattgatggtcgacggagaaccgcagacactgaacaaggagtcgggccctttattagattattatgtggttcaagcctattactgtaggtcggatgagggatatagtgatgctttggatggtcgttttgacagattattaaataaattcggttcgatagaggatgaagctacgattcttagtaaaacagtttggtgtgaggactttgaaaagcataaaggggatggcggaccggaatttacaactcgtgatggtattgtgacttattcattgaagggaatggcgatgtactatcgtccgggagtagatgcccgcattggcggagtgggtgcctaccgttttaatctttgtcgtccggtgaatgactatttctttatgcgtgaggttattcaggttctgaatcccgctaatcattaattgcaagaacataactaaaaaaggataattatgaagatgattaaattttcaagatatgttgtgctgggggcagctttggctgttgtcaccggatgcaacgatgcaaaactgtcaactatcgataatggagtatatattgcggaagcggctccttccaatacgtttggtcagcagatagaggcacaattggtggacgagggagatgtgataaagacattgactgttcgtctggtccgtgctattaatcaggatgtgactgtaacactggacatcgaccagcagctcattgatgagtataaccaacagcatgaagcaacttatgaacttctgccggaagagtttagaagttttgatcgcacagttacaatccccgcaggcgaagtgtctgcaccagtcattaatcttactataaagccgtttaccacccccaataacgaggcttatgcgattccggtacggatcacttccgtaaccggaccgataggacttgttggtaacgcaaaccatattctttatctgcttacttctcctaataagcagaaagcggtggttttaaaatcagcaaataaaaccagtctgaactttaaaaacgaaattcctgtcactcagtggactatagagtactggatcaagttcgacaatacaacgggcaaaccgaccggagattgggttggtcctgccaatatcgctttcagacgaaatattttcgcagacaattcggctcctatctctttcaatggcatcttactgcgttattgggcggatggagcaaagaagattgcgccttgtttgcagtgccagttggatggtaactattttgatagtgaagaattttggtatccggatacatggtatcatattgcttacacttatgacggatctactatctccctctataaagatggtacattgaataatagtaaagcagattcaagagacttcacattcaataatatcactttggcgcagagttttggctggagaatgcaggtggaacttgcccagattcgtctttggagcaaatgtctgacagagaacgccattcaggaaggaatgtcacgccagatatccggagagtcggatggtttgattgggtattggaagtgtgatgaaggagaaggaaatgtattgaaggataatagtccgaacggtaatgatataacgcttgccggaactcctgcatggagtgaacaatacaatttctatcatcctaatgattaagcggatggtcggagctttatcaattgattagagaatccgatacttacagatagtgaaaagaaaagccggctgcaaaggattacagccggctttttgataaatgggttttatgccttatttctcatcattctcgcgaatctccacgcgacgaatcttgccgctgatagtcttgggcagttcgtcaacgaactcgatcacacgcggatatttataaggagcagtcaccttcttgacgtggttctgcaattccttgatcagttcttctccggcacgtgctttatagtctttggacaatacgatagtagcttttactacctgtccgcgaatctcatcgggtactccggtgatggcacattctatgacggcagggtgcgtcatcaaagcgctttccacttcgaacgggccgatacggtaaccggaactcttgattacgtcgtctgcacgtcctacaaaccaaaggtatccgtcttcgtctttccacgctacatcacctgtgtagtaaatgccgtcgtgccaagcctcgtgtgtacgttccgcatcccgatagtactctttgaaaagtcctagaggtttgcctttgctggtacggatcacaatttgtccttgctctccggcttccacggagcggccttcactgtcgatcaggtctacgtcatactgcggattgggcagtcccatgcttcccggtttcggttccatccaaggcatggtggcaactgtcagtgtcgtctccgtctgtccgaaaccttccatcagcttgatgcctgtcagtttcttgaacgtttcgaatacggcagggttcagcgcttctccggcaatggtgcagtaacgcagtgaagacaagtcatatttagtcaggtcttcatgaatcagaaagcggaagatggttggaggtgcgcaaagggaagtcacctgatactcctgtatcttttctagaatagctgcaggcgtgaacttttcgtggtcatagacgaagatgttggctccggcaatccattgtccgtagagttttccccatacggcttttccccagccggtatcagcgatggtgaggtggaggctgttttcgtccagattgtgccagaagctacctgtaacgatatggcctaacggatacgtaaagtcatgtgctaccattttaggttcgccggtagtgccggaagtgaagtacatcagtgagatgtcgtcattcgtattggcatgtctcgggcggatgaaaggggcagcgttatcgattccctgatggaaatcttcgaatccttccggaacttccggacctacactgaccagcttttccacgctcggacactcgggaagagcatctttgatgtgttgcagtatgattccttcgccggcagccacaatcattttgatgtcggcagcgttgcagcgatagataatatccttctttgtcagcaggtgagtggcggggattaccgttgctcccagcttatgcagggcgatggtgctgtaccagaactcatagcggcgcttcagaatcagcatcaccatgtctccgcgaccgatgccgaggctctggaagtaagaggccgtcatgtccgtatagcgtttcatatcggcaaaggagaactgacggctttcgccctggtcattggtccagagcagagcgttcttgtcgggttgttcggcagcccaggcgtctactacatcgtagccgaagttgaaattctccggtacgtttattttcaggttcttgatgaaatcctcttgtgaggcaaagctagtctgtgctaaaaatctttctaccataacgttattacataattacggccagaaaacgtaccgttttgccatcgagcgctttcatgccatgtggaagttttgaattaaaataaatactgtctccttggttcaggatgatttctttgccctcgatgttgatcagcatacggccttcaaccaccaggttgaattcctgtccgttgtggtgattataatggatcggctcatcgtctcctttcggttcgactgtgacgatgaaaggatcggcggtgcggttcatgaagcccgacgccagtgactggtatttgtaagccctggtacgttcgatgctgactcctttgccggcacgggtcacgaagtagctgctcattttcggctcttcgccaaacatcaaagcatccagtgcgatattgtaggtacgggctatcttttgtagcatactaacggaaatgtcgtattgtcctgtctctgcgagctggtattcttcggcagatatgtcgcagtcgcgggcgatatcttcagacgttagttccagtacgtcacgtaatccgcgaaggcgttctgcgatctgtttaatttggtcattcatacaagtggttgttttttgattattaataattttgcggtattatttggatgctttcatcgctttgatgacggcggaggtaaatccgttgtgttccagttcgttgattcccttgatcgtaattccgcccggagtagtcactttgtcgatttccacgctggggtgggtgtcattgttcagaattaatgcggcggctcccttgacggactgggctaccatttccatcgcatctttgggacggatgcccatttcgatgccggcctgcatggctgcctggatgtatttcaatacgtaagcgatgccgcaggaagtcagtgccgtggtggcggctatcttatcttcggggatgagcatggccattcccatttcgttgaacaggcggagcataaacaggttctgttcatcgttcgtgttgcgtgccgcgataagcgtcatactttccagttcgctgatggcagtgttcggaatcaggcggaacatcggcatctccggtgctatcacaaagtgtgcgagttcttcaaaactgatacctgccgctacggatacgagcgtctgtttgctcttcagcttcaactcgcgcatgacggactccacaaaccaaggcttcacggcgagaatgacaacatctgctcccgttgccgcttccgtattgctcagagtggtggaaatgcccggaaattcttctttcagtttctccagtttgcctgcgctggggttggatacaatgatatctgagtctgctatcagacttccttttgccaggccgcgggctatagaaccacccatgtttcctgcaccgataatagctattttcatatgcgcttcttttttaatgtattcttacagacaaaggtaacggtaaattgcgaaaaaacaaaaagcagcctgaataagaactgtttttctgttcgaggctgcttttttgttcgctgtttattaatcaaatatcagttagagtactcttttgaaacgggcaaggaactcgtccgcttcctccatgctgaggcagagagggggcaataagcggagtacatttgtcccgctggctcccgtaaatacgtgttcgtcgtagatgaggcggctgcgcaattccttgatcggttcttcaaattcgagtccgatcatcagtccgcgtccgcgcacctctttgatttgcgggaatttcttgagttcttccagcaggtagtcgccgactgcttttgcattttctaccagattgtcctgttcgatgacgtccattacggcaagagctgccgagcaggccaggtgatttccgccgaatgtagttcccagttgtccgtagacgggcttgaacatcgggctgatcagtacacctgccatcgggaatccgtttccgatgcctttggctacggtgatgatgtctggctggatatggttgtattgatgggcaaagaattttccgctacggccgtatccactctggatttcgtccagaatcagaatcgttccggtttcggtacaaaccttgcgaagttcctgcataaattcggtagtcggtattttgataccgcccactccttgtattccttcgatgataacagcgcatacgtcacctttcgccagttcctgcttcatcgcttcgatgtcattcagagggagataggtcacatgaccgttgttgttgatcggagcaatgatggtggggttgttcgtagcctccactgcaagggatgtacgtccgtggaaggctttgctgaaagaaatgactttggtgcgtccgttatagaaagaagccagcttcagcgcgttttcattggcttcggctccgctgttgatcagaaacagcgagtagtcttcataaccggaaatctttcccaatcgttcggctacttgttgctgcagcttattgatcaccgagtttgaatagaaaccaagggttgctacctgattgctgatcatctccacatagtggggatgcgcgtgtccgatggagatgacggcatggcctccgtagaggtccagatattccgtaccgttctcatcccataccttacagccttgtcctttgactatattgatgtcatataaaggatatacgtcgaataatttcataattcttctgtttttagaaagcggaaggtttcagccgtaatcctacggtttcttccaggttgaacatcaggttcatgttatgaactgcttgtccgctggcacccttcagcaagttgtcgatacaggagataatcagtaatttgtcaccatgtttctccagatgtatcagacatttattggtatttacgacttgtttcaagtctatattcttatctacaatatgcacgaaggagtcttttgcataatattcctcatacatgcgaacgatttcttcgagtgcaactttcgtttttacgacaagagtggcaaagatgccgcgcgggaaatctccccgataaggaataaagtcgatctctgaatcgaagctgttctgcaactgcttcagtgattgcttgatttccggcacgtgctgatgatcgaaggccttgtatatactgatgttattgttacgccagctgaaatgactagtagcgccgggctttacgccggcaccggtacttccggtgatggcattgaccgaaatatcgcctgtcaacatcagatttttggctagcggaagcaaacctaactggatgcaggtagcaaaacaaccggggttggctacgtgcttcgccgtacaggtagcacgacggttcagttccggcagaccgtagatgaagtcatgatcgtcactcttgatgcgataatccatcgagaggtcgatgattttcaaatcttccggcacgttgtggctttccatgaatttcttcgtgtcaccatgagcggtacagaagaatagtacatctattgcgtccagaggcaactggtcggtaaatctcaggtcggtttctccgtatagtccttcgtgtacgtcggtgattcggtttccggcattactgctgctgttgatgaatacgatttcagtttccggatggttgagcagcagacggattaattcgcctgctgtatatcctgcgccaccaatgattcctgctttaatcatatctcttcgtctttatggttattgtagtaaacacgcagcggagtagaagttaccttaataaagcccttagcatcttcggctgtccagcctttctgcatttcaccatattcgccgaacttcgttttcacgaggtcgtcttccgattctacaccgacggtagagaaagaaagcgggcggagctcgaggattgccgtaccgttaacgttacgctggctttcctgaagcatggcttcgatgtcacgcatcaccggttcgagatactggctttcgtggaggaacattccgtaccagttggccacctgatctttccagtattgctgccatttgctcaatgtatatttttcgaggaagcggtgagcgccgataatcaacatcggagcggcagcctcgaaacctacacggcctttgatgccgataatcgtatcgcccacgtgcatatcacgtccgataccgtatgcggcaccgatctcttctaccttctggatcgcttggatcggatcatcgaatgtttcgtcattgacagctttcagttctcccttttcgaaagtgagacggagttgttcgctgccttctttttccacatgtttcagataggctgtttccggtaatccctgtgcagagtcgaggatttcgccaccacagatggaggtaccccacaaacctacgttataagagtatttcagtttggtgaagtccgcgctgaaaccatgtttgttcagatagtcgatttcttcctggcggctcaatgccatatcacgggtcagtgtgatgatttctacattcggagccagtacaaggaaagtcatgtcaaaacgaatctggtcgttacctgctccggtagaaccgtgggcgatggcatccgcaccgatttcgttggcataacgtgcgatggccaatgcctggaagatacgttccgagctgacggagatcgggtaagtaccattacgcagcacatttccgaaaaccatatatttcagactcttttcgtagtattcctgagtaacgtccaatgttacatatttcactgctcccagtttgtaggcgttttcttcgtttgttttcagctgttcttcgctgaaaccgcccgtattggcacaagctgcatatacttcgtaacctttttctttagcgaggtacatgacggtgaacgatgtgtccagtccgccgctgaatgccaccactacttttttcttcttttcttccatagtgctgtatatattaaatgttatttctttcttgttctttttttatgttccgcgggtctgtcggatcgtacagcatggctgtgcagatgcagaacttacggtttttagctaccagtatatcgtggttggtgcagccttcgcatcctttccagaaagcctcgtcgtctgtcagttcattgaaagtgacggggacatatcctagttcggtgttcattttcatcactgcggctccggatgtcagactgaaaatcttagctttcggccatcggagacgtgccagttggaaagatgcttgtttgatgcgctttgccaatcctaatccgcgaaaatcgggatgtacaatcagaccggaggttgctacgtattgcttgtttccccatgattcgatataggtgaaacctgcgaatgtgtcgccacagagcgcgattattgctttgccctctttcattttagtcgctacgtattcgtgtgtgcgctctgcgattccggttcctcgtacggcagcagcatttctgatagtttccaaaatagtgtcaacgtaaacctcatgtgaggcgtcggctaccataacatctatttgttgagtgtccatttctttatatataatataggtatagttattcgatattcggaatgatgagcgacaaaagctgacgtactttgcttgtggctactccttcacgcagaaccagcatgatggtatcgtcgccggcaatagttcccagaatctcgctgaactcattgttgtcaatatcataagccatgctgctggcgtaaccgggacgggtacgaatgacagctatattgccggaaaactgtagggagataaatccattgttgcgcaacatctcaccggcactctggtcagtggaacgtttatacatgatgttattcggcaatacatatacatacttaccgttcatacttgcagctttggctactttcagttgtttcaagtcgcgggagagggtggcttgtgtcagttcgaagccttcacggttcagctcttgcagtagttcttcctgcgagcctacctccttgcttgagataatcattttgatggcgtctaaccgatttgctttcttcttcattgtataattattctaagaatggcgcaaaattatgcattatttcggagaaacatgcataaatcatgctttttttgcataaaaagtaaaatttatactgatgtaaggtttggctatgcagatttgtgtcaaaatgcacatcctttctatcaaaatgtgtaaggaaaaggaggaaggaagcgcctatctttgcaatgtaggtaaatggataccttaaatatatagacaaaataccatgaaacagaacttttttgcagtcgacctgggcgcaacaagcggccgtacaatcttaggctcttttattgaaggcggattaaatctggaggagattaatcgttttcctaaccacttgatcgaggtgggtggacatttctattgggatatttatgcattataccgtcacattatcgacggattgaaattggtagctcaccgtggagaatctattgcctctatcggtatagatacatggggagtagatttcgtccttcttggaaaagatggaaacctgcttcgccagccttatgcatatcgtgatccgcatacggtaggagcaccggaagcctttttctctcgtatctctcgtagcgaggtatatggtaaaactggtattcaggtaatgaattttaattcacttttccaattagatactttgcgtcgcaatcatgacagtgcattggaggcagcagacaaagttctgtttatgccggatgcgttgagctatatgctgaccgggaagatggtaaccgaatataccattgcttccactgcccaattagtgaatgcacatacgcaacgtctggaaccggagttgctgaaagcagtcggactgaaagaagagaatttcggtcgttttgtcttcccgggtgagaagataggaacattgactgaagaagtgcaaaagataacaggattgggggcaattcctgtgattgcggtggccggacatgataccggatctgctgtagcagctgttcccgcacttgatcgtaatttcgcatatttgagtagcggtacttggtcgctgatgggggtggaaacagatgcaccggtaatcactgctgaaacagaggctttgaactttacgaatgaaggtggcgtagaaggcacaattcgccttttgaagaatatttgtggaatgtggttgctggaacgttgccgtctgaattggggagatacgagctatccggaattaataaccgaagcggattcgtgtgaaccattccgtagtttaatcaatccggatgacgactgttttgcaaatcctgcggatatggaacaggccattcgtgaatattgccggactactgggcagccggttcctgagcaacgtggacaaatagtacgttgtatctttgagagtctggctttgcgttaccgtcaggtgttggagaacttgcgtgcgctttctcctcgtcctatcgaaactctgcatgtgattggtggaggtagccgtaatgacttgttgaatcagtttactgctaatgctatcggcatcccggttgtggcaggaccgtctgaggcaacagctatcggtaatgtcatgattcaggcaatgacgatgggagaggcgacggatgttgccggtatgcgtcagttgataagccgttcaattccgttgaagacttatcacccacaggatatggcagcctgggatgcggcttatatccattttaaaaactgcgttcgataaattccggagaatcaagaaataaccgacagaataatattaacttttaataatagaatatcatgaaaaaagaagaaatgattcagaaagcgtatgagattgctgttgaacgctatgcagcagtaggtgtagatactgaaaaggtactgaaaaccatgcaggacttccacttgtcacttcattgctggcaggctgatgatgtaacgggatttgaagtgcaggcaggtgcactgagcggaggtattcaggcaaccggtaattatccgggcaaagctcgcaatattgatgaactgcgtgccgacattctgaaagccgcttcttatattccgggtacacaccgtttgaacctgcacgaaatctacggggattttcaaggtaaagtggtagaccgcgatcaggtagagcctgaacatttcaagagctggattgaatggggtaaagagcataacatgaaactcgatttcaactctacttcattctcgcatccgaaatctggtgatttgtcactgtctaatccggatgagggcatccgtcagttctggattgagcataccaaacgttgtcgtgccgttgccgaagaaatgggtaaggcgcagggtgacccgtgtatcatgaatctttgggtacatgacggaagcaaggatatcactgtaaaccgcatgaaatatcgtgcattgttgaaagattctctggatcagatatttgctactgaatataaaaacatgaaagactgtattgaatcaaaagtattcggtatcggtctggaaagctatacagtaggttccaatgacttctacatcggttatggcgcatcccgtaataagatggtaactttggataccggtcacttccatccgactgaaagtgttgccgacaaagtatcttctcttttgctttatgtgcccgaattgatgctgcacgtaagccgtccggttcgttgggattccgaccacgtaaccattatggatgatcctacaatggaactgttcagtgaaattgttcgttgcggtgcgttggaacgcgtacactacggtctcgactatttcgatgcttctatcaaccgtatcggtgcttacgttgtcggtagccgtgctgctcagaaatgtatgacacgcgctttgctcgaaccgattgccaagctgcgtgaatacgaagctaacggacagggattccagcgtctggctctgctcgaagaagagaaagcgcttccatggaatgcagtatgggatatgttctgcttgaagaacaacgttccggtaggcgaagatttcattgcagaaatcgaaaagtacgaagcggaagtaacttctaaacgataagtgatggatattctaataggcttgttgattatagccatcggtagcttttgccagtccagttcctatgtacctattaaaaaggtgaaggaatggagctgggaaagcttctggttagtacaaggtgtgtttgcctggttggtgttcccattcctgggatcactgctggggatacccgcaggaggcagtttgttcgacttgtggggagccggaggtgctggaatgagcatcttttatggtgtattatggggaataggcggattgactttcggactctccatgcgttatctgggtgttgcgcttggacaaagtattgcattaggtacttgtgccggattcggaaccctttttcctgccatcttcgccggaaccaatctgttcgaaggtaacggactaattcttcttctaggagtttgtattacgctggcgggtattgctatcattggttatgccggtggcttgcgtgcacagaatatgagcgaagaagaaaaacgggctgccgtaaaagactttgcattgacaaaaggtttgctggtagcacttcttgcgggtgtgatgagtgcctgctttgctttgggattggatgccggaactcctatcaaggaagctgctttggcaggtggtgtggatggactttatgcaggtcttcctgttatcttcctcgtgactttaggcggattcatgacaaatgccgcttactgcctgcagcagaatatagctaataagtctgtcggtgactatgccaaaggaaaggtatggggtaacaatctcgtcttctgtgcgttggccggtgtgctgtggtatatgcagttcttcggattggaaatgggtaagagcttcctcacggaaagtcccgtgttgctggctttctcatggtgtatcctgatggcgctgaacgtaacctttagtaatgtatggggaatcatcctgaaagagtggaaaggagtatctgccaaaacaatcacagtgttgatctgtggtttggtagtcttgatcttctcgctggtattcccgaacttgttttaataataaatagatatgaaatcaattttagaaaatcgtccggcacttgccaaagaagtaaacaaggtagctgaagttgccggatacttgtggcaaaaaggatgggctgaacgtaacggtggtaatatcaccgtaaatatcacagagtttgtagacgatgaaatccgtcggatggaaccgatcagcgaagtaaaatccattggcgttacattgccttatctgaaaggatgttacttttattgcaaaggaactaacaaacgcatgcgtgatctggctcgctggccgatggaaaatggttcggtgatccgcattctggatgattgcgccagctatgtgatcattgccgacgaagcggtggcaccgacttcggaactgccttcccacctgagcgtacacaatgatttgctgagcaagaattctccttataaagcatctgtccatactcacccgatcgaactgattgccatgactcattgcgagaagttccttcagaaagatgtggcaaccaatctgttatggagtatgattcccgaaacgaaggcgttctgtccgagaggtctaggtatcattccttataaattgcccagttcggtagagttggcggaagccactatcaaggaattgcaggactatgatgtagtcatgtgggaaaaacacggtgtttttgccgtagactgcgatgctatgcaggcttttgatcagattgacgtgctgaataagtcggcgctgatctatattgctgcgaagaatatgggcttcgaaccggatggtatgagtcaggaacaaatgaaagaaatgtccgttgctttcaatcttcctaaataatacttgtattaatcactgaatttatctactttagcgaccgcagcattttctatcgatggagaatgttgcggtaactttaaaattatgacacaactatgaatcgcattattctgaatgagacctcttatttcggtgcaggatgccggagtgtaattgctgtggaagcagccagacgtggctttaagaaagcctttttcgtaacagataaagaccttatcaaatttggtgttgcggccgaaatcattaaagtatttgatgacaatcatattccgtatgaactttatagtgatgtaaaggctaaccctaccattgctaatgtgcagaatggtgtggctgcctataaggcttccggtgcagactttatcgtagctttgggtggtggttcttctatcgacacggcaaaggggattggtattgttgtgaataacccggattttgccgatgtgaaatctctggaaggtgtggctgataccaaacataaggctgttcctacctttgcattgcctactactgccggaactgctgctgaagtgactatcaattatgtgattatcgacgaagatgcacgcaagaaaatggtatgtgtagacccgaacgatatccctgctgtagctattgtagatccggaactgatgtattccatgccgaaaggactgactgccgctacaggtatggacgcgctgactcacgccatcgaaagttatataactccgggtgcatgggctatgagcgatatgttcgaactgaaagcgattgaaatgattgctcagaacttgaaagcggcggtagataacggtaaagacacagttgcccgcgaagcaatgtcgcaggctcaatatattgccggcatgggattctccaatgtaggtttgggaatcgtacattccatggctcacccgttgggcgctttctatgatactcctcacggcgttgccaatgcgctgttgttaccttatgtcatggagtacaatgctgagtctccggctgctccgaaatatatccatattgccaaggcgatgggcgtcaatacagacggtatgacagaagctgaaggtgtgaaggcggctatcgaggcagtgaaagcgctttctctgagtatcggtatcccacagaaattgcatgaaatcaatgtgaaggaagaggatattccggcattggcggtggctgcattcaatgacgtttgcacaggtggtaatccgcgtcctacgtcagtagcggagattgaagtattatatcggaaagcattctgattttaattgtataaggtttgttttttataagcatccggaggatctggacaggtgctccggatgtttttttactgtttagcgtgtgttttttgaaaataattcctacttttgttcaattcaattgtatgaaaacacgcctgtatgactgaggataataatctgggattagaatttaaatacttgatagttaatgacatggaccgcaaattcggtctgtgggtgaatacggttggctatcagtctatccctcccgattctccttatccgctgaaggagcatccgtccggttactatttcaatgccgaaaaaggaagagtattgcgggaatatcaattggtctatattacaaaagggcgcggtttgttttcttccgattctactcctgaaagacaagtttgtaaaggtcggctgatggtgttgtttcccggacagtggcatacttattatccattgcggcagaccggatggacggaatattacattggttttgaaggtccggcgattgatacgattgtgggcgatgcctttctttctcaggaaagacagatattggaagtcggtattaatgaagaactggtatctttgttttcccgcgctttggaagtggcagaagcggataaaatatctgcccagcaatacctttccggaatcgtacttcacatgattggtatgattctttcgatttccaagaataaggtcttcgagatgagtgatgtcgatcagaagatcgagcaggcaaagatacttatgaatgaaaatgtatccggcaatattgatccggaggaactggcgatgaggctgaatatcagttactcatggttccgcagggtttttaaggaatataccggctatgcacccgccaaatattttcaggaactgaaacttcgtaaagccaagcaaatgttggtgggaacttcccagtcagtaaaagaaatttctttttttctgggcttccagtctaccgaatattttttctcctttttcaaaaaacgtaccgggcttactccgcttgaataccgctcgttcggtcgggaagaataaacataaagttatttattgttaatctcctcgatgtgatttaacctttccgttttaatctggtcaaatataatattgcaatgatgcaatcggtttattatcagattaactataaaagaaaaaagaaatgaaaagaatcgtattttggatggtagctttgctactgatgagtggtgtggcaatggcacaaggaaatcgccagggtggaagacaacagatggatccgaaaacccgcgcggaacgtatgacagagcgtatggtgaaagaatactctttgaatgaagatcaaaagcaacaattacaggatgtcaaccttgcatgggtgcaaaagatggctgctaatcagggcggacgttcgaaagataataaggctgccaagatgactaaggaagagcgggaaaagaagatggcggaaatgaagaagtcccgtgaagattatgatgcccagttgaagaagattatgactaaagaacaatacgatagctatgtgaaaaaacaggctgaacgtgagaaacagatgaaagaagggcgtcagaaccggcaaaaaagacaagggtaatatagattgtaatgaatggatgtacttcctttcggaagaagaattaaggagatactactgatttttgaggtagtatcttttttttgtattcaggtgattcttattttgcttcttgaggttgtgaacaagtcacatcctgcttgtttaaaaatgagtctcttatatggttaatttgtttgttattaattaattaacctgttaataactttgttgataacgtggttgatataaaattgggattgtgaataaacgaactgtaaacagtggaatctaaccggagagagataaaaaaagaaccgcttgaaaagcgattctttagtaagttgcggagatccgactcgaacgaatgacctttgggttatgagcccaacgagctaccaactgctccactccgcgatgtttaacgggtgcaaaggtacggcttttcttgaataaaacaaattattctccaattattttttagaaaaaagattgtgttatctatattgtgctgaaaatgagagaagtattgatggaacttttttttagtacctattaatatacaaatgttaatattctgtgcgttttcttgtgtggtctaaagaaaagaattacttttgctcaaaatattcagcaatgtgcaatttgtataacctatgaccgtatcaaaaacgaaagccaagttagtagacgttgcccgccagcttttcgcaaagatgggggtggagaacactacaatgaacgatatcgccctcgcttcgaaaaaaggtagaagaacgctttatacctattttaaaagtaaggatgaaatctatttggctgttgtagaatcggaattggatatcttgtcggatatgatgaagagggtggctgataaaaacatttcgccggacgacaaactgttggaactgatatatacccgattggatgcagtaaaggaggtcgtttatcggaatggaaccctgcgtgcttatttcttccgtgatatatggcgggtagaaaaagtgcgaaagaaatttgatgcgaaagaaatccagatttttaagactgttcttttggaaggtcaggcgaaaggagtgtttcacattgatgatgtggagatgactgccgatttgatacattactgtgtgaagggaattgaagttccttatatccgtgggcatataggagctcatttggacgaagaaacaagaaataaatatgtgtccaacattgtgtttggcgcactgcatagaacagaaatttaattaaataacttttagtatgggattattagacggaaaaacagccattgtaaccggtgccgcccgtggtattggtaaggctatcgctctgaagtttgctgccgaaggtgcaaacattgcatttactgacctggtcattgacgaaaatgcagaaaaaacaagggtagaactggaagcaatgggggtgaaagccaaaggttatgcttctaacgctgctaactttgaagatactgcaaaggtcgtagaagaaatccataaggacttcggacgtatcgatattctggtgaacaacgccggtatcactcgcgacgggctgatgatgcgtatgagcgaacaacaatgggatatggtaatcaatgtgaacctgaagtcagcgttcaactttatccacgcttgtacacctgtcatgatgcgtcagaaagctggtagcattatcaatatggcatctgtggtaggtgttcacggtaatgcgggacaggctaactatgctgcttccaaagccggtatgattgcattggccaagtctatcgcacaagaattgggctctcgtggtatccgcgccaacgccattgctccgggattcatcctgacagatatgactgccgctctttctgacgaagtaagagctgaatgggcaaagaaaattcctttgcgtcgtggcggtactcctgaagatgtggcaaacatcgctaccttcctggcatcagatatgtcttcttacgtatcaggtcaggtgattcaggtagatggtggtatgaatatgtaatcgaacagtatgactgtcgtatacgaagacaaccatataattgtagtcaacaagaccgcttccgagattgtccaggcagacaagacgggtgatacaccgctttcggaaactgtgaagcagtacctgaaagagaagtatcagaaacccggaaatgttttcatcggtgtgacacaccggctggaccgccccgtaagcggccttgttatttttgccaaaacgagtaaggcactcacccgtctgaacgagatgttccgtaccagtgaagtgaaaaagacctactgggcagtagtaaagaatgcccccaaagagccggaaggtgaattggtgcattatctggcacgtaacgagaagcagaacaagagttttgcttatgacaaagaagtgccgaacagcaagaaagcgattctgaattatcggctgatcggacattcggagaattactatctgcttgaagtagacttgaaaaccggacgtcatcatcagattcgttgccagttggcaaaaatgggatgtcccattaaaggagaccttaaatatggcgctccgcgttccaatcccgatggcagtatttgcctgcatgcgcggaaggtacgattcatccatcccgtctcaaaagagctgatagagctcgaagctcctcttcccgaaggaaatttatggaaaggatttgaactgctttagtcagtgcaagtcctttttcttttgccaaaagagtaaatatccctgccatccattcggtaaactctggcgacagcctgatagtatcgaaatagagtttatatttgcatcatgaaaactataattcatgaagtaaatcctaccatgaaacaatttcgaattaacaagaaaaatacagatgaacgcatttaaacttttaatggctgcttcctgctttttaggtctggcaacgagcggagtggcaaaacaggactattcaaagagtgagggattgttacagtatgtcgatccttatatcggctccggttttcacgggcatgtatttgtcggaacgagtgttccgtacggcatggtgcaactcggacccaacaatattcataaaggctgggactggtgttcgggatatcattattccgacagtattctgattggtttttctcatactcatttaagcggtacgggatgtaccgatctgggggatattctgattatgcctctcaatgaaatccgtactcccagaggtaaccaggatgatatacgtgacggttatgcgtcgaaatactcacatgacaatgagatagcccgtccggaatattattctttaattctggacagatacaatatcaaggccgaactgacagctactgaccgggtaggttttcatcgttatacctatcccgaaggaaaaccggcctctatactgattgacctgcgtgaaggaaacggttccaatgcatacgacagctatattcgcaaagtagatgactatacagtggaaggttatcggtatgtcagagggtggagcccgtcgcgaaaagtatactttgtgctgaagagcgatcagaagatcgagaaatttacggcttatgacgataatacccccaaactttgggatcaactgaaagtagaatcggtgaaaagtgtgcttactttcggcaatgtgaaagaagtaaagattaaagtggctatttcttccgtaagttgtgacaatgcagcgatgaacctgcaagcggaactttctcactgggacttcgacaaggtggtgaagatgagcagtgaccgctggaacaaacagttggataagatgaccgtagaatcagacgatgaggctgccaaacgtgtgttttataccgcacactatcataccatgatcgctcctacattgtattgtgatgtcaatggtgagtatcgggggatgaatgatatgatttacacagacccgaagaaagcgaattataccactctctccctttgggatacttatcgcgccttgaatcctctgatgactatcattcagcccgaaatggtggacaatgtaattaattcaatgctttccatttatcggcaacaggataaacttcctatctggcctttgatgagcggcgaaacaaattgtatgccgggatatagctctgttccggtgattgcagatgcttatctgaaaggatttaccggatttgatgcggaagaagccttgacggctatgaaagcgacagcaacttatgaaaggcagaacggagttccttacgtgatggccaaaggatatatccctgctgataaaatccacgaagctacttccatcgctatggaatatgcagtagatgactggggaatcgccgctatggcacaaaagatggggaagacggctgattatgagacattctcgaagcgtgcccattactataagaactatttcgattcttctatccatttcatccgtccgaaactggaagacggttcatggcgtactccgtacgatccggcacgttctattcacggagtcggcgatttctgtgagggcaacggatggcaatatacattcttcgctccgcaagatccgtatggattgatcagcctgtttggcggtgacaagccgtttacatcgaagctcgacagcttctttacgaacaatgacagtatgggtgaaggtgcttccagtgatatcaccggtctgatcggacaatatgcgcatggcaatgagccgagccatcacatagcctatctctatacctatgccggcgaacagtggaaaacagcggaaaaggttcgtttcatcatgagcgacttctacacagatcagccggacggtatcatcggtaatgaagactgtggacaaatgtctgcatggtatctcctttctgctatgggattctatcaggtgaatccgtctgacggtgtgtttgcattcggcagtcctcgttttaaaaagatagaagtgaaagtgcgtggtggtaaagtgtttactgttgaagcaccgaataatagtaaagataatatctatattcagaaggtttatctgaatggcaaaccttatcataaaagttatattacgtacgatgatataattaacggcagtactttaaaatttgagatgggcaaaaagcctgccaagaattttggtaaagcttctgccaataggccgatcgttttgaataaataggtaaaaaatagtttttaggataggtattggttaggatgatgaacgccttcaagtgtttgcggaagcatatatttgaaggcgttttcttattgtcaatgacagatatggagatgaaaaaagaaggcgtatcaaaagtcaaaagtaactaaaccctcctccttcaggaaggaggagtacccgtaggaggggagtttagttactactgacttttgatacgccttctttttgtttgtgagatattacttctgttttattttcggtttatcaataaacctccaactcgtagattcttgcagccttcagactgttgttttgtgtagattgtgtaaccagcagtctgacgtaacgtaccgaagtcggcttaaactggcgaactaccgtgtttttcttgttatcactcagttcatcaatcgttttccattcttcgtccggactgtttctgccttgtaagaagcaggtatgagtgataaagacgctgccttcatttccggcatttaccaacttccatccacggatcgtctgttcctttccgaagtcgaagtcaatgtagttgggagccgtgcttgtatcacaccatttcgtcttcacatcaccgtctacggcatatcttgcaacttctttttcgttggtttcaccggaacatttgattagtttggcttgtttcaacaggtttgctttacttgtcgcttcttctccgttgcctgctttcaaggctgtgcggaacaattccgaagccggagttactgccggatacttctcgttaaccagcgttgcggcaaataatacgatatctgcatgatccggtaaagtaaccgtagtcgctcctttaggaatatccatgccaaacttgaacatatacgtaaactcataagcctcatctttgtcagaagcatgacggtgagtgccgacataagcgatttctgcatctttcaggaagccttccgtatgtcccagatgttcccactgaccgataaatccggtataggaaggtacggtgatttcctgtgagttgttaccggtgctgaaggtagcaactgcatcttcaccggcagaggctgccaggaaatagatacggttgtaagaatgtccggttggcaactgaagtacattgcctttgcaagtcaaaccattggcaatttctttctctcccaagcggaaaggaatgccgtcagctttcaggatggagtcggggagaagttctgctgcatagctgttgcccgattcgaagtttccttctttgcggaaagcattccagctgaaacatctgcgatcatagtccaaaggcagataagcgtatgccggagcttgaagatcagcttttttcttcagcttcactttaaatgtctgtatgctgtagggagcgatggatacattcagctggttcttgttgaagtcagcgctgccgatctctttttccgtaccgtctgcaagtactgccttctctatttcaccggcgaaggtgatggctgcctgttgcggagctgcgcctcctgtttcatatacacgtactacatattcatcggatacttccgcttttttcagcgctttgataacgacttgatcgttgcttgaacgcacaaaagcaaattccttacctagtgttccggtatgtttcggactgctgaaggctttgatcggctgattcagaatttcagctttgatggcggtggcgggtttgtcaagtgctccgttatgtcctgtgaggctataagtaaatgtatggaagccgaagtcctggtgatcctgataagcgtaatttccttttgtttccggtgtatggagaagagtcagacggatcgtgttgttatccggtttatcccagccatatttactgtcatttaggatcgatacaccgtagctgttgttcttatcggtcaggtctgcccattgctgcgcatatacttcgtaagcggtctgtacattattgcctctttccacgctgccgattcccagatcgtaagtagccttttcattttctatattcagaggaaactctgctttcagcagcgtgtttgttgactgccagtctatttcgttatagaaatctatacggtcggcacggctgccttcgtagaggcggatgtattgcttgaagagcgatttgccatacttcttctcaatgcagagtgctttacggagtgcgccgttttccactaaagtgatctttgcgccgtctgtgatggagacaggttcacggtcgatggtctctttcaggatttcccatgcaggccatgcgtacgacttgttttcggtgaagagtgccaggcgaatcgcttttccatcttttacgagttctttgttgttgcgcttgtcggtcagtgagatgatatctccgtttttatccagtgtgattttgtagacggagttttcgatggctgaggcggctgaaggagagatcgttttttcagatcctccggtgcggacatcgtacactgcataactgtttgcgggcagtgacgctgcaaccaggatgtgagcacgtccgttctcgtaaccgatcatttgcgaagcgactttcttgccttgtgcattgtatacagtgaagcctttcggggttttaggctgttcgaggatgatctctgtcaagtccgataccgggaaagcgtttgcattataaagaacgacaggcgttcctttcacgcgtgtatccatctgtccggcaatggcgttgacggaagaagtcagtacttgtgagaattgttttagagagatcagttcatcgttccatgagaactcataggcacgggggatactcgttcccgtcaggtcatcatggaattgatggaagatgaaacgtttccatgcctccgtcagcgtgtgttgcggatagctggcagtacccaaccattcggcagcgaccgccgctctttctgctgcatcgcccaactgttcgttttgccggttgtacagcttcatggctgcctgcgaagtatagcaacctgttccgtgaacatccatcaataactctccgtcaaataccggcagttccgggtgattgttgaacggcagataatctttgaacaactgatcgctggtagcactgatcacctctaccggaccatcacctttgattccctgttctacagaacgtaccgaacccagagtaggagaaccaccgatgtcccctgttccataatagcggtagaccgtattgagcggagtacgttgggctaatttttccagatctttattcttcgagagatcttcgttgttccatttgcgtccgtagtcatatccgtgggctagcattacttgtttgccgtcaatgcccttccagagtccgatggtaaacggatgcttgctctttccatagaagggatgattacgccagtccagcttctgtgaagagaagccgatcagtccgcagtgtgcggcaatggtgggaagcgtccatccgaatccgaagcagtccggcaggaagatatccgttccttcttttccgaactcttgccggtagtacgtctgtccgagcatgatgttacggatggaggcttcgacggaaggaaccaacacatcacttgcttcccagctacttccggcgatatgccagcggccttcctcgatgaatttcttcatctcttcatactgttcgggatagtattccttcatccacgcatacttcactcccccttcaaagttgaaaacgtattcgggatatttctttagcagaaataagttctgactaatggtattccagacatattcgttgattgttgtctggatgtcccagttccactgggtgtcgaggtgggcgtccgacaccatataggctttcacctttttcttcgcggtgtcatcttgtgcatagcttcctcctgctaaggcaagggcgagggctacggcaattacttttttgttcatcatggtttatttttaacaagtttagtagtttacaaatttatacaaaactaatggaattaattctattagggtttagaatagtacttctttatggaaatggcacggatatttacctttttggcaccactttacatctagaaagtattcttgtccggttcgggctgcatcttgtcagtcataaagaatgattgctcaagaagctttttgtcattcaaaacgtgtccaaatatagcggatttcgaatgattagctgtcctttgtagtgccaatatgtaggcaaatatattttgtctgttcagagtactctatggataattagggtataagataagtagctgattatcattctataatatatgtttgtgaacaatgaaagtacagcaggtgtcggcaatgacaaaccagtatcaatactctctgaccattttatcttatcatgttttttagatgttgcggtaataactcccatgatatgctctccatttgtttcccggtcattacgtttattgcagttgatgtagaaaagaaatttacaatgattcttttagtgtttgttgataaaatagcttttcttgcataacttggttatataaactcaaattcccgttctccatgtcccggcatgcagatgagctgcataatctccaaagtggcatgagatttcattgtgataaggttgcctgcaccttttatctgtatttcttaataatgtgatgtctgtatacattccatagttatcccaatatgtgtctgttagtaggccgggacctgttatgtctaaaatctcctgttgcgattttaagattattgtggctctttctgccatttcatccattattctgtgtaaaaaaggatgtttagggattccaccgaacatatagttggctattcgaagtcgatatcttaaattcaaggcttcttgctctgcctggcagacaattttctcttctcctaaaaccaaattatactttctcaactcatcaagtggctttaaacttaacatatctaaatccatatagaatcctccatagaggtatacaagggctaatcttaagaagtctgctttttgtacattgtgatagaatgcattataggcttcgatgtattcaggtaaatcttgatttaatatatcctgtgcatcatccttattatataggcggatattccagtccggatgattgacttgtatttcttgtttgcatttctcgaatagttcggggaacggttcatctttgcgtagaaagataaggtgtatattctttgggatcattatttattttatttttaaaggttacttaccaaaccaggtaccaaagaaatagtgtatggcatgagcctgattgatacgctcttccatttctttaggaatctggttgttttttattttctctacctcccattgtccgataggatatattgtctttgattcgaggatacgtatgtcttctttatgtggaaatgcgttgaatgcatgcgttagcaagaaagggcctgtggaatccagtatatcaaatccgttattaacaactttcccaccggaatgattgattaacctttggcatacaaagttgataaaatcattatcgggtgttgacgccatgaaagcgttgcaaatgatatattcaaaaccaaagcgtttagcatgccagtcgggttccttacctacgataaaatccgatccttctagtaagaactcaatattttcgaggcactcgaaatccatgtctacgtacaatcctccataaactttcaagagaagatagcgtatagcgtctgctctttgtatgttacaaggatatgtatcatacttctccaggaaatcagggaaatgtttgcagacaaattccctgttcatttcatctgtccataggatatattcccaattcgggagatattctttccatgtttgtggcagttggtcaagaggagaaggtacatcttttgttttccatgtttggtggataattcgtgggattcttaaactgtttttcatagtctttattgttgaaatattttcttttctttaatattttctcttctatatcgaatgagggtttcattgctcttcaacatgtccggagtgtagatttgcggttgataatatgcctcttccagttttttaaactttccatccggcattatctgatatttagtatctatacgttgccctttcaggttatctaggtgtataaaatttctttttatactatcgaactgaatgatgtaattattttcaggaaagttcaactgttgaacattcaccgtaaaatctttattgatttgtgcttccatggttctagctttgctgcatgttccaggccattcacaaatgggaatgtagtcaatgattgctcctgcaaaattgaatgtaactaaccaatgtttatccatatcgtgaagagctgaccaagttctgactattcccatgatatattttccattagtatcttcaatgagagaaagaactgtttcaatgggaggtctcttgtctcttttgtcaagattagcatagaatggagaattgcttattctataagatgtaccttgagttactgctctcgtatgttcaaaatcatcacgagagatactgttgttgtcttggtaaacaaagaatgaaatatcataattgatgggtagctttaggaactcattttttgaaaaaacatagaatacacgttgcaagttcttttcttttatatccgatagcttcactaaagaagtgactttgtagctgttttggccatacatagatagtccgcttgccattattaatataattaaaattgctacttttttcatggttgattattatttatagatgatgatagagtccacggtaaaagtggactctatcgtttcgttctaggttatacatttttatattataaagatgttgtatcatatttcccaccgtcgttgggtcttacttgagttacagtataatatctgttagcaacctttgtgcttccctctagctttaaattttcagttttgtagtaaaggcgattaatgttgctacatccatcatcagagttggaagttgcattatccataaatgtatagtaatactgttgtcgtgaagtatcatatcctcttcctgtaactacaataaaatggtctgtaccgtcgatgtttggatttaaatcgagatcataatcaactcctactatgataactcgttttgcattgagatgtttatcgatacattcaattgcatttttgtagttttgagctggatcatttccccagtttgttaataatccatttgcagaatcaactagcttaaaaacatttaagctacttccgtaattggataatccatatttttttagtgtttctttgcaaagacttaagcaattagctccttctctccaaccaacaaacctacttttgtccattaattctattggatctttgggaacgggtttgtctccacctccaggtttcggaccatcaccgctagttcctccaccgctagttcctccaccgctagttccaccaccagtccacccgctaccacttccccaatctccacttccccagtgtccgcttccccaatactcgccagaaccactaccgctgccggaaccactaccggaaccgaaacctgatccgctaccgtagatagttacgtccggtgtcatccatccaatgccacatacatagacggtggtatctaaggctccttgggcattaagccgttgataaacttcttctgtcatgcaatcattgggacctgtacctgcccctgaattgtaactggagatcaatatggtttggttgatccctcttaattttaatttctccgctttacttttcttttccataatacatgataattttagtgtttataaataaagtcgtttcttttggatgcatagataagtttatacacttgtttaagttgaaatcaattgatacatatcaccccatgataaagaagatattctacttccgtcagaattaatttgtaagtttgttctttatctttgctgatttcagatgaaaaacaaggtagcaattcgttgaacagacattcaaatgtcttctcttcttctatgagaatcagaatattataacataaatcgttaataagcacttctttaaaaccctcatatagcagacatggaatgcatactatatcaaagtggtctgaatggcactctttgtttatacgttctttaagcagtttttttgcttctgtcggccagggttccggaatttcgtaaatggataggtagggatttctattaatagtaaatatggcttgttcctcttttccggcatttagaaacatgaaataggaagatgagcatttctcccaatcatacagatcggtataagatagcttttcccattttttggacaaagaatgaagataatcttgataggatgcaatacacatttgtacactcaaatcggggaaggtagtatttttagccttgttttgcattcgcttatgattattcgcgaacaattctactactctattgtaatagtcaggatatttatttaatagagttttgctaagtaaatcacaaatccgttggttctttttatgtccgccgatgatatgtaatagtttggctttgtcgtatagataaaaattacagaaatcatcataaatgtatccattgtcacgaacgctgtgatcaaggactgttgccacaggtttgttataactgtttgactgggcataaaacaatatttgttcaaagaggatattgttatttatgtgaatatctttgctgtttatatcatttaaatggtttgattcgataaagttaaatgcagtccggcagtattcagctataaactccaagtcatttcctccgataattcctgcattatatgacatgatagagtctttttctaattctttttttaggaaggatggcattaataaatctttttgtagaatatgattcatcatacttttataataactgcttcctatttctttgttctgagcaatcaattcactcatctctatggtgttgtctagtttattaggcaaatatacatctccgtctacatgtatgaagggttctttttggagtgaataggttaataacttgggatatgcccaatgaggttcagggcaagttagattgtcgtattgaatgatgatatctgtatacggtagtttcaattgttcggcaaagatttcatatccatgggaatcggtatataaaacgatattttgatagttgtcttttaaagaaagacaacttaatgcccatgacattaaatggtattgtggattcatccatccaaaactattgtctaacaatgaattatttccatgccaaaaggtttgtactattttcataactattgatttgttgtgtgttatttctatagtgataaaattagtaataatgtggaggaaaaggtccttcagatagggctaattcgcatggttggcgcaaatgtttacttttttggcagtgaaatatgttttttgtgcatcaatcttgataaatataagaactgcaaggatcagcacaacctctgttcattcagaattgtgtaatccttgcagttttatttatgtcgggtagaaagaaacagtttgtttagggcagcggatctgcggcagcaggtttcttcggattgtagatagccatacccaccttggaatctgcgcaaccataatacagataccatttatccttataataaaccatcccttcgatgaacaccgttccgtctacatactgcccgctcttttcgaaactatccatcgggcggaagaacggttcgtcgagacgggtgatgaaacgggtcgggtcattggcgtcgaagagggcttgtccggcagcgtaaacattggcggtatagcgtttgtcgcctctgcttgcactgtttttaccattatacagaagtacgattccctttggagtataaatagctggaggaccgcattccgtcagctggctgtcgaagtgtccgtcacggggtgaaaacagttttctcagcgagccgtccgtatttacgtatggagtccagttgactaaatcttcggaagtggcggcaaacacatgttcctctccccaatacatgaagtattttccgtcgattttcttgatcacctgtttcccattgacaacttcggtcagaatggagccggacttgcatcctaaattgaagaacttgccgtcatatgctttggcaaaagcgggaccgtgctttgtccagtctttcagattgcgggaagtggctattgccagacgcggaatgtggcggttccattgcgtataagtcatcacatacagtccttctgctgtgacggcgatacgcgggtcttcgcatccgcccggccattccagtttcttttgagtatcgttatccggataaaataccggagtcttttcccgcttgaagtgaatgccgtcactcgaagtggcgtatccgagacgtgaggtacggtgaccgataccgacaccggatttatcttctgcccgatacagcacgacaatcttgccgtcatgcagggtagctgccggattgaaagtgtcattggattcccatgcaacgtaatcctgtgtcatcggacaatagaatttcgtgttctctataggagatatcaccggattagctccctgtggtcgttcgaagcctccgaatgcccaatcgggtaatacgttctttttgtcgttggaaggttgtcccaaggcggtacaagtcatcatggttgtagtaaccagaaataaaaaggttgatttcatattatataattattattttggggagtaatatatactctctacatataaattaaaaaataaagatttgctgtcatctgtcacataaatggtggcaaatgaatgattatgtgattgttatgaggtgacggcaaggtgtgatagcagagtgacagtagttttgctgtcactgtggcatcgcggagacgcttacggcgaagaaggtcggtttctgtgccttgataccaaagtttcgtcggcgagaaactaaagtttcagcggtgagaaactatggtttcatcagtgagaaactttagttccagcggcttgaaactttagtttcggaagcttgaaactttagtttcaaaagcatggaaactcttgtttcatacagtgaaacgattggttccaaagcatggaactatcggtttcaccgtatgaagcagttatcttataagtaaagatggagtagagactactgaatgctgttcaataagtccactttgccttcattgaccagtttgaggatcagctctccgaacaacgtattctgccatgcaaaccatgcacgggtaaagtttttcgggtcgtttttgttgaatgattcgtgcatgaagccggtacctgcatccgtatccatcagcattttgatgcaagttttgatttctgcgtcattctggctggtgaaggctttcatcatgatactcatgggccatatcatgtcatatccgatatgcggacctccgataccttccccggcactgcctttgaagaagtaaggattgtcttcgctccatacaaacttgcgggtattctgataaatcggatcagtcactttgacgtcgcccagataaggcagagcgatgagactcggcacgttggcatcgtccatcagtagctgattgccgaagccatctacctcgaaagcataaatcttaccgtatttcggatggttgtagacagcatatttctttaatgctttttctacttcatccgccagtgcggtacattctttggccagcgccggtttcttgttcacggtgttcagaatttcggcagctttgcgcaaggaagtgacggcgaagaagttggaaggaacgaggaactggaaagtcgtagcgtcatccgaagggcggaaagcggaagcaatcagtccgacaggtttcaccggattgccccagccatcattggtcatggtgtcgagtgcgcgttcggtcttacgctggaatctgtacggacctttcgcgtcgtccttacgctgctgttccttgaaagtcttcagcacatttgcaatggcctgcaaccattcgtcggagaatacgctggcatcgcccgttgttttccagtaatggtatgccaggcggatcgggtagcagagagagtcgatttcccatttgcgttcgtgaagttccggtttcatgtccgtcaggtcgctcatccattcgcctccttcggagttcatgttgaaggcgttggcgtacgggtcgatattgatacatttaaactggcggttgatgactcctgccagcatctttttcagttcggggtctttattggcaagctgcacatacggccatacctgcgcaccggaatcgcggagccacatggcgtggatgtctccggtgtatacaaaagtgtcctcttttccgtcgaagtgaacggtggtgtccagtgtgttcgggaagcagttctcgaacatccatgccagtttcgcattggtcagtagttgcttgatgtggtcaatctgccgttccacttcctgcgatacgaataagcgcttggaggcttcggggcggttggtctggtaattattgacccgggtattgtcttgctgggtcacaaattcgcggttttccattgcttgcacgccggcagcgcccgaaagtgctgcgcagaggcaaagtgttttggttatattcatggtaattgtttttttaattcatgtaagggttaataatcaatgttttatttctcgatttcagcgaacagctcgatcaggcaggcattatcgagcagccatttataaggttcctcgttatgtcccgaccagtctcttcccaataatccgttggcatcccgatagtttctccatgcgtggagcgcgttctctgccatcgcacggacataagtcgggttgtggtcaatcttctccagcgccttgaagcctctgaacagaatcacgttaaaccacgacatatccttgtgtaccttgactgacgggtctttcttatctgctttcgaacggaaaaaggcatcggttcccgcggctgtcttctgggcatcgcgcaagtaatccttgtctcctgtctcttcgtacagcaatacgcctgcctgaatcatttgtccactgttgtaggcgtacttgtctttcgagactttccctttcaggttgatattgtcccagtaaaggaagtcgtcgggatcacacaagtgttttctggtccatgcgtaagtttccttggccttgtccagatactttttgtccttcgtcagacggtatagcttgacgccgagtactgttgacggggcattggagcaggtgtgcttcgcttctttctgctgttcgcaccagaagattcctccgcccagttcgttactccagccgctgtagatgtattcgtacagggcaatggcctttttcagatagtcggccttctttgtgaggcggtagtagtcgcaataatccagtgcgatccagatgttgtcatcgtagtagcgtccatgctgaccgtatttgactgggtacgactgataacatgccggaagtcgttctccgtcccagtactgttccagtcccggcaggatgcgcttttccagtatcgtcttgtacttcttgtctccggtagcctggtacatggctacgcaaccggacatcatccctgagtagggccacagaaaggaggccttcaaggttccgttctgctgtgctccgcccgccagataagtgattttctggtcgggattcacgggatatgtttcggtaagcagcccgtcttccgtctgatataaattcagaacattgtcgaggatagagtcggcaatggacacgaaaggatgattttccaccgtttttccggaagcggaagcgaggcaaaacaacatacaggctacaaaacatatatttctcatatgggtatcagattatttaatgaagtattcggggttatttttgctgacgttggtcaaacaccaattccacttttacagggaaatggtcggatggcgtacgtgcttcataagccttaatggtgatctcttccggacaatctctcacgtcctcctttttactgttttcccgtacactccgataggtatctgtcagcacaccgtatctcttgacgtggaaagaaggtgaaacgaagatatggtcgatgcggctttcggtaaaactgttcggatcgaagttgttgaaagttccgttgagcgcatatcggtagtcgcacttctcgtaagaatcgcagaggacgcctttgctgacaaatgcgtcgtaggactggtgggtctggtcgacgttgaagtctcccgtcaggatagccggcagattcttgcctcttcccagttctttcatcttttcctgtacgaggaaagcgctctccacacgggctttcttgccgatgtggtccatgtggagattgaagaacagaaactcgaaaccggtatctttgcatttgaagtgaccccagctgcaaatacgaggcaatacggcatcccagcctttgctcggcatgtccggagtttccgacagccagaaatctcctttctctacgatgtcgaatttgtcggtgcggtagaagatagcggagtgttcgcctttgtctttaccgtcgtcgcgccctacaccgatatagtcatagccgggaagggcttctttcatgtctttcagttggtgaaggaagcattcctgtgtgccgaaaatatcgaaatcgtgatattgcacgatctgggcaatcaccggataacgctgtccccatccgtctccacgggcggagtcggaaccgttggcatttctcaggttgtaggaggcaacggtgagcgaagtaggctgatagctctggcagttgcagaagactatcgctgcaagaacgataaataaaaggtttcttagtttcatgttttctttagtttgtttggattagatcattcattaaagcattcaaaagtacgacattttattcaaatgaaagggaatacggaatatctttttcagtcgttccccgctgtttgttcggcgtaggactcatctgatactggatattcgctcctttcagtaattggtcgtgcgtcagataattgcgggtgaataccttgccatttaccttcatatccttcacataacggttgtcggtgttattgttgttcgcttttattgtgacggtttttccattttccagatgcagcttggctgatttgaaaaggggagttcccagaatgtactgatctgttcccggacaaacggggtagaatcctaaagccgagaagacataccaggcagaagtctgaccgttgtcttcgtcaccgcaatatccgtcggggcctgccgtgtagagcttgtccatgatttcacgaacccagtgctgggccttccaaggttctcccgaatagttgtaaagataaaccatgtgctggataggctggttgccgtgagcgtactgtcccatgttcattacctgcatttcacgcatttcgtggatcatgccacggctttccataccctgtttgcccggaatgacaaagacggaatccatcatgttgttgaactctttcttgcctcccattaggtctatcagcccttgcggatcatggaatacgcagaaactccagtgccagctgttgccttcgcagaactcgccgctccagtctgctgcatcaaatttggggttgaacacacctttgtcgtctttgcccaccatcagtttgggtttcgggtggtagacgttcttgtagttcagtgcacgttgtttgaagatgtcgatttcgcttgccggtttgcccagtttcttgcctagcgtgtagatggtccagtcgttgtacgcatattccagcgtgcgtgcaacattctgtcctataccgatattgttggggacataacccagtttgttgtaggcgtcgtatgcaaggcggcccgaagctgtgccgcggagatgggcgtttgcgtcatgtttcaatgcttcccaaagtgtttcgatgtcatatccgcgcagtcctttgatataagcgtcggctactacggaagcagagttgttgccgaccatacagtcacggtgtccgggacttgcccattccggaaggaatccgctttcaaggtacgcattgaccagtccttcctgcatcttctgattcatggacggatacatcaggttcaggaatgggaacagacagcggaacgtatcccagaagccggtatccgtaaacatataccccggcagcacttttccgttgtaagggctgtagtgtacgacctgtcctttggcgtctatttcataaaaactgcgtgggaacagcatcgaacgatagaggcaggaatagaaagtgcgcagattgtcgatattatcgtcttccacatctactttgctcatttcacggttccagatgtcttttcctttagtgaccagctggtcgaaactatccttgcccagttctttgagattcagttccgcctgctcataactgataaaagaagaagcgacacgtgcgtgaacgatctcccctttctgggtagcgaatccgatgatcgctccggtatggttgccctgaacttctgtttcgttcgggagaatgttgttctctttcacgccggaagtaaaggtaaacggtttgtcgaactggatgacaaagtaattcttgaagttctccggcactccgccgctgttcttggtagaataaccgatgatcttgttttcttccggaatcaccttcacataagagcctttgtcgaatgcatcgataacgacataagcgttcttggtttccggatacgtgaaacggaacataacggcacgttccgtcggaacgagttccgtagtaacgtcgtggtctgcgagatacaccttataataataaggcttggcaatctccgctttgtgcgagaaccagctggcgcgttggtcctggtcgaataccagtccgcctgtgatcggcatgatggaaaactgaccgtagtcgttcatccacgggctgggttgatgtgtttgtttgaagccccggattttgtcggcatcgtaggtatatgcccaaccgtcgcccattttaccggtttgcggtgtccagaagttcattccccacggcagtgccgtagccggataggtatttccggtcgataactcaaacttggactgcgttcctaccagcgtgctgacatagtctaccggattcttgacggcagaaatttgcatgctgtacaacaccgcacctccaataaataacaggtgtttaaatgaaaaatgtgttttcatgaacaaatgaatttatgaataaaattagtttctgtgacgaaaatagagagaaaaggaatgccgctaccggaagtcgaaacactaaatcgccctgtggcgctataattaaccaaactggcacgcattcttacatatattctgcgccaaaaaagtgctggaaagtttttttgtttacctttgtcatattgcaaatctaaggattctatgccatgaaaaaacattgtattttacttttcttctgctgccttaatctgctgatgaatacagccggtgcctataatctgaagcaggttgccgacaaagaatatatgtccaacagctctattacttctctgtgccaggacgacaaaggactgatgtggatcggcacttgtgacggactcaatatctatgacggtcaggagatcgaagagtttaagacccgtgacaaggaggattacttatccggcaatcaaattgataatattgtttataccggtaacgatacttattggtttcagacttattatagcctgatacgcctggaccgtaaaacgaactccattacacgctttaatgagtttcagaaactcttcttgatgaataaggataatcatggcaccttgtttatcattaaagacaccaactgcatctattattttcataagaaggaaggcatctttaagaaaatcaatgtgaccggtatcccgatatcggatgtcattactttcttctttgataaaaataaccgtatgtgggtgatgatgaaagggtataaccggtgttatgacctgcaacaggaccctctgacggagaatatcactttagtatcgcagaaaagcggtttggatcatcacacgccattgatttgtagcttttacgatgacgccgccgtttactacgtggataaagaatacaatctctatgcctttcatattgagagtaaaaagaatgaatttatagctaacctgggagcgaacatacaggcgcatgacaagatttcctccattgttaaatatcatgatagcttttttgtcggcttaatgatggacggtgttctgacgttggaaaaacaaaagggcagcggtgaatatcagattcagaccttacctataaatagcggaacattcagcctgataaaagaccgctttcaggatgttgtctggattggtacggatgggcagggcgtttatctttactcaaatcctctttattctataaaatcggtggtactgaataactataccgaaaagatagaacggcccgtgcgtgctttgctgcttgacaaggagcgtactttttggatcggtaccaaagggaatggaatacttaaaatttttgattatgaggtacaaaagaatatctcggactgccgctcggagatactgacaacatcgaacagtggtttaggcagtaatgcggtctactgtatcagagaaagtaaccgtaacttgctatggatcggtgatgaagaaggactgaacttttattcgtatcgtgaacgccgtatcaagaaacttcctctctggattgataatgaggaattcaaatacatacatgatatttatgaaacggaggactcggaattgtggctggccagtgtggggatgggagtagtcagagcgcgtatcggaggtacaccggatcatccggttcttgaaaagttacaacgatatgtggtcaatggcggagaattcggctctaattacttctttacgatctgcaagggggacagtctgaacctgttgttcggcaatatgggatacggggtataccgcttcaatgaaacgatcaacggattggaaccgctgaccactcataagtatgagaatatgaacttgaacaaggtagtacctattataaaagatgatgcggacaattatttgatcggtactacttatggagtcatcaagtatgcctcagaaaactcttatcaactgtttaatgcgaaagacggttttctgaacagtactattcatgccattctgaggcattcgtccgataacttctggctgagtacgaatcagggattgattaattttgataccaaaagaaatgtattccgctcttacggctttggcgacgggcttaaagtcgtcgaatttagtgacggagcttcctacagagacccgcaaacgggtatactgttttttggaggaatcaacggctttgtagctattcaggcagacggacgtcccgaacagctttatatgcctcccatctactttgacaaactctctatctttggagaacaatacaatcttggagagtttatcacccgtaaaaaagagaatgaagtactgaatttgaaatacgaccagaacttctttgccgtttcattcacctctgtcgattatctgaacggaaataactgcacctattcctataaactgaaaggattgagtgacctgtggattaataatggtaaagaaagttctgtctctttcacgaacatggctcccggtgagtatacgttattggtgaagtactacaatagtgtattcgataaagaaagtgaagtctattctttgttgatacggatcggtgacccgtggtacgcctcttggtgggcgtatctcatttattctttatgtctgcttatgatagccgccatgctggtacgttcattcattctccgcaccaaacggaaaaagcaggaactgctgaatgaaatagagaaacgccatcaaaagaatgtatttgagtcgaaacttcgtttcttcactaatatagctcacgagttctgtaccccgttgactcttatctacggtccttgcggacgtatcctttcatcaaaaggactcagtaaattcgtagtcgattatgttcagatgattcagacgaacgcggaacgtttgaataacctgattcacgaactgatcgaattccgccgtatcgaaaccggaaaccgggaagtgaggatcgaagccctgaatgtatcttccttaatgaaaaatacggcaaagacctttgtcgatatggctaaatcccggaatatcacattcctgagcaagatacccgagcaagtttcctggaactcagacaaaggttttctgaatactattattatcaatctgatatccaatgctttcaagtatactccggatgggaaaagtatcaaaatagaagtggataccaacgatgaaaacctgctggttctccgggttgctaatgagggaagtacgattaaagaagaagactttcaatatgttttcaaccgttatgctatcctggatagctttgaaaaccaggatgaaaagaacttctcccgtaatgggctgggacttgccatttcctacaatatggcgaaattgctgaatggtatgctgaaggtggaaaatacgcctgacggctgggtattgtttactttgtcattgcctccgctggaagtgactaccggcgtatcgtcttctaaacgaatcacttcggaatacattccaaaaatagagtcgcaactggtgctgaaacttcctcactatgaatttgacaagatgcggcctacattgctggtgattgatgatgaactggaaatgttgtggttcatcggggaaatcttctctaacgattttaatgtggtcaccctgcaggagccggaacgggtggagcaggtattgaatgaagtttatccgaatgtgatcatttgcgatatcatgatgccgggagttggcggtatcgaattgacgaaacggattaagtcggtgaaggaaacgtcacatatacctattattatggtttccggccggcatgaaatggaacagcagatggctgcactttctgcaggagccgagatgtatatcaccaaaccgtttaatgccgaatatctccgtatctctgtttgtcagatgttggaacgtaaggaagtactgaaggattatttcagttcagcaatcagctcttttgaaaagacagatggtaaactgacacataaggaatcgaaaaagttccagcaatctgttctgaagattatcaatgaccacattcaggagaaggaactgactccccgtttcatagccgatcatttggctatcagcgttcgcagcctttaccggaaaatggaggagatgggggaagaaagtcctacgattatgattaaggagtgtcgtttgtatgtagcgaaagatttgctgctgaaaacgaaaaagacgattgatgaaattgtattcgaagccggattctctaataaggtcactttctttaaagtatttcgtgaaaagtacggatgcacgccaaaagaattccggaccaaacacttggaagaagtacaataatcagtcccttctgttgactgtctgtatagcataacgagactttttccggaaggtgaagagtctgattacactgagagaatatgctctatagcaggtttgtaagcgagtaaatgtctatgccaaaaaagtaaataagaagttcgttttcctgttatcgatattctgaatcttatctcagccttcattgcggggaatttaacttttaaagaaaaccggaatattatcaaatcatgccaaaatagtaaatatccctgccgtgtggcataaaacacgaagaaggaaaactcagaattttggcaaacacgctaattttgctgatgcaataaagaagcaggaatatatataatatgtttaactaaatatctcatgaaactatgaatcaacaacacgatcctccacttaatttatttaagtatgcaatgattcctttttaccttttatttcattttgtttgaattaaatttaatatcttatgaaacctaatttatttatgaagcgtaagcttgaaatcggacttaccttattaatagggatgtctgccttttggggttgcaacaatgacttggctccgatacgccaaaatcaagccttacctcccgatttgagtaaacactctgttttcgaaagtttctctcccgacagtggtggtatcggaacacagttaatcatccgtggaaaaaatttcggttccgatccaagttatgtgaaggtcactgtaaataacaaggaagcagctattgtaggaatggacgatgaggtaatctatgccatcgttcccgcacgtgcagatacaggttatgttcgtctgtttataggtaaagacgaaaatatagaagagtatgcttccgagacaaaattccgttatcagtttaagcgtaatgtgacgacgatggtgggacaacacggtatgaatggtcgtgaggacggcagttatgctgcttccaagctgcagagaacctggtttttgctgactgataaagacggttcggtattctttatagatgaaggacgtggtcagacacagaatggtgctttgcgccgtgcacgtaatggtgaagtggaaactttggtgcagtgttccagcggtccgtttcagtcacctacctgtctggcgttcagtccggctcaggacactctttatatctctcagtattcctatacggatgagagtaataccaagactgacttcaatattatttatgtaacgcgcgaaggtggattcgtggatgtaagaggactttgcagagcgaagaaagtcggcactacaggactggcagtacatcccaaaacaggggaagtgttcttctgtaataaaggtactggctatgtgtatcgttttgacggaccgagttacgaagactttacccctctcttccgaattaacaatgcaacggaaattgaaacccgtatgacttttaataccgaaggtacgatcctttatgtagcggtatgtaaccgccattgtatctatcaggttccttatgatgctgctacacatacttttgggaatccggttctttttgtcggcgcatgggatgaaagtggctatatcaatggtacaggtgcgactgtccgtctgaataagccggagcagatggcatttgatgaagacggaaatatgtttgttcccgaacgtaataaccacattattcgtaaaatcacaccggcaggttccgcttctctgtacgccggccaacccgagcagagtggatttggtgacggtttgcccgaagaagcaaaattcaatcagcccgaatgtgtgacggtttatccggacaactcggtctatgtggctgaccgcgataaccatgttattcgtcgtgtgacagtagaataaataatctataaaaagaattatccatgaataatattcaaaaatgtatcgtattactcttgacggtaatgctgctcgtgcctgatagtgcatgggcacaggagagcaagcaggaatttgtaatcaagggggtagtggaagataatcttggtcctgttgccggtgcgtcgattgttgctaaaaatcagccgggcgtcggtacgattaccaacttagatggagagtttaccataaaggtgggagcttatgatgtacttcaagtgacttttattggttatcagacagttgaaattcctgtgttatcgatcaaagaccggaataatctgaaagtgaaaattgtagaagataaccgtaagattgatgaggtggtgattactgccagtggtatccagaagaaaaagaccttgaccggtgccattaccaatgttgatatcaaacagttgaatgctccgggagctaatctttcgaatgcattggcaggtgttgtaccgggtatcatagcgatgcaaaccagcggtgaaccgggtgaaaatatgtcagagttctggatccgtggtatgagtacatttggtgccaagtcaggagctttaatactggtggatggagtagaacgtagctttaatgagattccggtagaagatattgaatcattctcagtgttgaaggatgcgtcggcaactgccatttacggacaacgtggtgcaaatggtgttgtcctgattactaccaaacgtggtgaaaaagggaaagtgaagattaatgtgaaaaccggtttcagctggaatactccggtgaaggttcctgaatatgcaaatgcttatgattgggcgagtttggctaatgaggctttggaaggacgttatgaaagccctctgtatacaagtgaagagatgaatattatccggtatggactggactctgatctttatccgaatgtagactggagagacttgatgctgaaaagtggagctcccagctattatgccaatattaatttctccggtggtagcgataatgtacgttatttcgtatcgggacagtataccagtgaagacggacgttaccgtacttccagttctgaaaataaatacaatacaaatacgacgtatgaacgttggaactatcgtgcgaatgtagatatgaacttaacccgttcaacgatattgaaagtgagtgtaggcggatggttggttaaccgcaattctccacagagcgatgcggatgatatctggaaatcctttgcttactatactccgctgtcttctccgcgtaaatggtctacaggtcaatggccggttgttaatggcatgactacgcctgagtatcagatgactcaaaccggatatcgcactatttgggaaagcaaagtagaaagtagcgttgctttggatcaggacttgtcgtttataacgaaaggcttgaaattttccggagtctttgcttttgatacctataataagaataccatccgtcgttctaaagcgcaagagttgtggtctgcggaatattctcgtgacgcaaacggtaatctggtgttgaagagagtacagaatgctgctgcaatgtctcagacaaaaaaagtggaaggagataaacgttattatttgcaagcttctttggattatagccgattgttcgctcagaaacatcgcgttggagtgtttgctatggtctatcagcaagagactactgacgtcaattttgatgagagtgatttgatgggatctattcctcatcgcaacttggcttattcaggacgttttacttatgctttccaagataagtatatggcagaatttaattggggttatacaggttccgagaattttgaacatggaaagcaatttggctttttcccggccgtatctgccggatgggtggtttcggaagaatcgtttgtgaagaaagcgatgccgtggttggatctgtttaagattagagcttcttatggtgaggtgggtaatgaccagttgagaactagcttgaccgatgataaggcacgtcgcttcccttatatatctttggtaagtacggatgatggaggatcgtatacttttggtgaatttggtactaacaaagtacaaggttatcgtattaaaacactgggaacatcgaatttgacctgggaggttgccaagaagtatgatatcggtgtggatttcagtatctttaatgggaaagtcaccggaacagtagattactttgttgataaacgggatgatatctttatgcaacgcaatcaaatgccgctgacaaccggtcttgccgaccaaacacctatggccaatgtaggtaagatgaaatcagtcggatgggatggaaatatcgctttcacccagcagattggacaggtgagtctgcaactccgtggtaattttacttatcagaaaactgatatcctggatatggatgaggccgccaatgaattatggtacaagatgaataagggtttccaattgaatcagagccgtggttttatcgccctgggtttgtttaaagatcaggaagacattgacagaagtccttctcaggcatctttggctaacaaaacaatacttccgggagatattaaatataaagatgtgaatggtgacggagtcatcacaacggatgatgaggtacctttgggatatcgtcagcagccgggacttcagtatggtatcggcttgagcgccagttggaagaactggaactttagcatgcttctccaaggaaccggtaaatgtgactttttcgtaggcggcagtggacctcatgctttccatgacggtcgtacaggtaatattctgcaagttatggtagatggtaatcgttggattccaaaggaaatttcgggcacggaagctacggaaaatccgaatgccgactggcctcgcctgacttatggaaacaacaatatgaacaaccgagcatctacgttctggttgaaggatagaaaatatctgcgcttaagaaatgtggaactttcttatgactttcctcaggtatggacacgcaagttccttgtgagtaatctgcgtcttggatttatcggacagaacttgtttacttgggcaccgtttgactggtgggatccagaaggtacaaatgaatcgggaagtagctatccgattaataaaactttctcctgttatcttcaatttagcttttaaatcaaaaactacgaattatgaaaagaatactttataccatattgctggctataggtacattgtccttctcgtcatgtaccgattatatcaatgtggacaaatacttttatgatcaggtatctttggactccgctttctccaaacgtgtgtatgtggatggatggttgtcgagtgcatacagtgtaatggattatattggtgaatatagagaaccgttccgctgggctagtgatgatctttaccatccggacatgaaggattatgtggaaggaaactatagtgctgataatcaattgagcgataaagatcaaaatgagtcacgactgtggaaatattatgaaggtatccgaaaggcatctactttcattcagaatgtagatcgctgtccggaactgacgatggatgaaatagccgatatgaaaggacaggcacgtttcttgcgtgcttattgttactgggctttgatacgcgtctatggtcccgtacctttgattcctttggaaggactggatgtgaatctttcttatgaagaactttccttgccacgagagcattttgataatctggttgattttatagatcaggaattggctgaatcagcccgttcactaccgactaaaagaacggtcaacaatcttggacgtccgactcgcggagctgcattaggacttcgttcacgtgtgttgctttatgcggccagcccgcttttcaacggaaatacggatttctttaatgtgaaagactgctatggtaatcaattagtgtctcagacttatgatgaaacaaagtgggcgaaagcggcggcagctgctaaggatgtgattgaattggctaaggcttccggtctgtatgaactgtatgttgtagcgccgaaagcgaccgttctgccttcacaacgtcctcctcataatgcactttattcggataagaactatccggaaggttgggcggacgtagacccgttactttcttataagtccaactttgacggtacgattctgggatcgaaaaatccggaacttatatttacccggacaagaattggaacaggacatatcaatgactgggcttaccaatctacgccaaagactttaaaaggaaacaatcggttggctgttactcagaagcaggtcgatgcgtatgcgatgaacgacggacgttctatcacagaggcggaagctaccggtgattacgtaacccaaggtttcactacacaggcgtatgctgtggcgaatcctttcctgccggctaaggtgaatttgatgtacaataatcgtgaaccacgcttctatgcgtccatcgcttataatggttcggtttgggaagcttccagtgcttctgaatctgaattccgcgatcaacagatattctattatcgtggtctgaacgatggcaaacagggatttaaggaagaatgtccactgacaggagttactttaaagaagttttataattcggaagactcacggactgaaggcggatatctggttgataaaacagagatgaccattcgttatggtgaaattcttctgatttatgccgaagcgttgaatgagttgacttcgggacaagtttaccatctgactacctataccggagctgatgtagagattcagcgcagtgtagatgaaatgcgttatgctatcaaacgtatccgtatgcgtgccggagtacctgactattcagaggagacttataataacccgaacgatttccgtgtgaaattgaaaagagaacgccagatagagttattgggtgagaatagtatgcgctactttgatttacgccgttggaaagatgctatgacagaagaaaaccagttattgcaggggtgtaacattaatatcagtgatgatgaaacgcgtattgctgatttttataaacagactatcatcacctcggtacacaaagtgtttgaacagaaaatgtatttgtggcctttcccgacttacgagctgaaacgtaacgtgaatatgacgcagaatcctgaatggtaaaactaaataaaattggcttattatgaaaaaaataatatctatatacggaataatgggaagtctgctgatcgctatgctgcccggagtttcttcatgcgataaattggaagatgaattattcaagaagaatacatatatcattcataatggttggcaggattactcattggaggtagctgatgataataccaccgtacttcctgtatatttcggagtaaatggaacatcgggaaatgataaggaaattcatataacgatggaagttgacccggatacgctggatgcgtataataaggacaagtataagagtcagacggacttatattataagatattgccggaaggaacctatacgtttgatgccgattcatggaatattaaaagtggagaattgaatgcggcggcttatattcatatcgacttgaacaagatcagagaagtaggcaacttgtataatgattatgtacttcccttgcgcatcacttcttctacaggagaagagatgggagcgaataaatatacgaaagtattggcacatatcggtttcaagaacgattattcaggtatttatagtggtaagggcgttgtgacacaacagggaacaacttatacgactgaaacgaccagcacacaactttatgcaattaataataatacctgctatatgtttgtgggcgagaagacacgttccaacactacggactatctgaattatgtggttgaaatagaacgtgatgatttcggagacataacgttaaccagccatgtggatggattgaagtttaaaccttatagtgccaaactcagtcgtaaatatacgtataactatacagaccaacgttattatacagaaattactaccattgaattggcttatgaatatcaggactctgcacagggcgaatcattaatgatgtcgttcgaaggtactttctccatgtcaagagatgtattgagagtagactatcctaatgtagacgtagaagagtaatttaccttagttataatatatatgaaagtgatgaaatacttcgttctcgcatcattgctttgtcttagtgcatgcagcgatgataacgacaacaaaaataatgagacaccccagaatctggcagagctaaccgttgacgccagtgaaatcagtatcgcacagggggataccagaaccgtaaaaattacgtccggtaatggcgaatatgaggtgacttcggcaaacgaagaagtggtgacggcagaagtcgatggtgatatagtgacactgacagctgtagaaggacataacaatgctcagggtgtagtatacgtgaaagacaagtactaccagcgcgctaagattttggttaacacggcggcagagtttgatctgaagttgaataagacgttatttacgctttattcgcaggtggaaggcgccgatgaagctttcgttaaaatctatacaggaaacggaggttattcgctcgaagtgatagacgaaaataattgtatcgaagtcgatcagtctacacttgaagactcggaatcattcaccgtgaaaggtatcgcccagggaaatgccgaggtcaagataactgaccggaaaggaaaagaagcctttgtgaatctgaatgtgattgctcctaaacagattacgactgacgctgatgaaaagggtgtactgatcaatgctaatcaaggttctcagcaagtaaagattttgagtggtaacggagagtataaaatacttgatgccggtgatacgaaagtagtccgtctcgaactttatggtaacgtagtgacagtgaccggaagaaaagccggcgaaacttcctttacgctgactgacgccaagggacaggtatcgcaacctattcaggtgaagattgcaccggacaaacgttggtgtatgaatctgggaagagactatgccgtgtggacgcatttcggagaaatgacaggcgaaggagtagaagcattgaaagctgcgaccaacgatttcaaattgaagaagatgacctgggagctgacttgccgtatcgataatacttattggttgcagaccattatgggtaaagaaggttactttatcctccgtggcggtgacgatggtgaaaaaggcaaagaaggcggtaatcagtggaaagtcattgacctggtaggtaaaagcgataaattacatctgagaacagggcataatgcgattaagcttggcgagtggatgcatctggctttggtggtagactgtgacgtagcacaaagtaatccgagtgaaaagtacaagctttatattaatggcagcagagttgcctggggagaaataaagaagaatgatctcaattacccggaagtagatctttgcgcaggaaatgacggcggaaaaatctccattggtaaggctagtgacaataatcgtttcttgggcggagctgtacttgaagcacgtatctggtctgtttgccgtacggaagcgcaactgaaagccaacgcatgggactttgtggaagaaaacccggaaggtttgttaggacgctgggatttctctgccggtgcaccggttgcttacattgaagacggcactgactccgatcatgaattgttgatgcatgtttgtaagtacgacagcttcaatgctacagaatttccaatgagcagatttgaggaagctcccatagtagtaccttttaagtaatctctaaattcgaagaaaaatgaaagcaatattcaaactgtttatattgaacctcttggctttggcattacttccgtcctgtagtgatgatgatcagtcaaactcagaacagaatgatccggtcagtggcaatatttctccggtaggttcatttgcggtagaagctaccaataacgagaatgaacttctggtgaaatggaccaatcccagtaatcgcgacgtggatatggtagaactctcttacagggatgtggaagcgagcttgtctcgtgctaccgacttctcgccgggacatatcataatacaagtagagcgtgatgtcacacaggaatatatgttgaaagttccttattttgccacttacgaagtttctgccgtagctatcagcaaagccggcaagcgatcggtacccgaaagccgtgtggtgatgccttatcatgaaaaggtggatgagcctgaactgaaactgccggaaatgctggatcgtgcacattcttacatgacttctgtcattggatattatttcggcaagagttccagaagctgctggcgtagtaattatccgtatgatggaaaaggttattgggatggtgatgcgttggtctggggacaaggcggcggtctttcggcatttgtcgctatgcgtgatgcaaccaaagagagcgaagtggagaatatctatggcgcaatggatgatatgatgttcaaaggaattcagtatttctgtcagctggatcgtggaatcctggcttattcctgctacccggctgccggtaacgaacgcttttacgatgataacgtatggatcgggctcgatatggtcgactggtatacggaaacgaaagagatgcgttatctgacacaggcaaaggtggtatggcgctacttgatcgatcacggttgggatgagacttgcggaggaggtgtacactggagggagttgaacgaacacactaccagcaagcactcttgctctaccggacctactgctgtgatgggctgtaagatgtatctggcaactcaggaacaggaatatctcgactgggcgatcaaatgttacgactatatgctggatgtattgcaagacaagtctgaccatttattctatgacaatgtacgtccgaataaggatgatcccaatctgccgggcgatcttgaaaagaacaagtattcttacaattccggacagccgttgcaggcagcctgtctcttatataagattaccggcgaacagaaatatctggatgaagcgtatgcgattgctgaaagctgtcataagaaatggtttatgccctatcgttccaaagagctgaaccttactttcaacatccttgctccgggacacgcctggttcaatacaatcatgtgccgcggattctttgaactttattctattgacaatgaccgtaaatatatcgatgatattgagaagtcaatgattcatgcgtggagcagtagctgtcatcagggcaacaacttactgaatgacgatgatctgagagggggaactaccaagaccagttgggaaatactccatcagggggcattggttgaattgtatgcccggttagcagtactggaacgtgaaaaccgatagttgaatgattcccgttcagggaaaataagaacataaaaaagccatccccggaatagacgaagtagggatggctttttttgtagtgtgcttactattgttcggcagactatgttccgtgagtttttggaaaggttattcctttatagattcagctgtttttttgtgaacaatttatttgtaaataaattgttgtcttgtattaagtagggtagcaattaaaggtaaatgtgtactttatgctaaatagcaaaggatgaaatttaatgttttatagtaataagtagttatgatttaattcttgttatgaaagtaaattactatgtcgagagcgtgatttcttaatttattttctattgtccctaatcttaatttaaggatattcagtaattgtcctgtttaaagatataaaaaagaaactgaatgtctcaaatatagttcgatctcctttattttgctatttactgaatgtctgtatttgtaaagtgagctttttcgttctttagaattatcaaaagttttatatataataattaccacagtctaacatcgatattaaataagaaaggttgagtaatttcatctatattacagtataaagtgaataattggggatcgaatgagatataatacgctggggaagtacgatctacgacagatatagttagtccgttgtttttaaaataatttttatctatagaaagggtctgagtctctttatatcctgatttttttagatatctatcttgtacggaataacttacagaactatctccgtatattatagaagctctgaaattgcttaaatcttgctcccataaataccctgtgtaagatgcagtaaaagtaaaagtaatttcaactattacattcttttttgttaatgaaaccccatctttattatatatattattaatggcaggtagtggatcagaccatggggataattctcttacatattgatattgataatcgctctttattgtggctaattcttttctttccattgtccttaccctaaaaaaaatttctccaaacggataattcttttttcgcaaatatattggattctcaatctgaattactgcatctttccaatcactttcatatgcatttctaatggtagtatattggagttgcttatataacccctttttgccgtgataatattccccatttatgtatttgtcagttctgacgtcaatcacccagaggtcagttgtatctttggaacctgaataaggatctaaatctggacgagtaagataaggctcatctaaatcatatccattggaacgagttgtagtggtattctcagaagttgagactagtggggaggtacttgaatcttcactagtacatgaactaatgataaatccagcaagccaaaatgatagaattaatttaattgttttcatgaatataagtttttagggttaatacttgcatagttttcaaaggtagtaaatgtttgataatttatatgtttgggttaggtgtttgataacatattgagatatgtcttatataagattaccggcgaacagaaatatctggatgaagcgtatgcgattgctgaaagctgtcataagaaatggtttatgccctatcgttccaaagagctgaatctaactttcaacatccttgctccgggatacgcctggttcaatacgatcatgtgccgcggattctttgaactttattctattgacaatgaccgtaaatatatcgatgatatcgagaagtcaatgattcatgcgtggagcagtagctgtcatcagggtaacaacttactgaatgacgatgatctgagaggtggaacgaccaagaccggttgggaaatactccaccagggagcattggttgaactgtatgcccggttatcagtgctggaacgtgaaaaccgatagttgaatgattcccgttcagggaaaataagaacataaaaaagccatccccggaatagacgaaatatgggatggctttttttgtagtgtgcttactattgttcggcagactatgttccgtgagtttttggaaaggttattccttgacaggctcagccggtttgtctttggatgcagtgtcagtaacgactgtatcgttgacaatagcggtcggtgcactcagttctgtcttaacaggttcctcgctcttggttacagtatcttttactactgtatcattaacgatagctgttgcattaacttctgtcagggctgtcgcagcttctgcagagttctgagcctttacaaggaatgaaccaccacaaacaaacataaacattgctactactaatactaattttttcataatcgtttgctttaatgattattaaacatatattttcaattctctcttatgtgttaaggaatcggttgttgctttacttaactttttaataagtatcaaagtatgtgccaaagactgatatgtgctgtcaatgcgttgattattagtggtatatataagtgacgtacattgcctatagtgtggaaatgtatggggaatgtgtggaaaatggggcaggaagtgtggaattattccacaatagtgtgctttgctatgcaggtaataataagtaatgaaagaatggctgtgatacaatgaacttatgtttatgtgacagtgaattgaaatgtagtaaataagtgaccgttctgctactgtttattagtcagtcatattgattctctaaccataataatcctgtttttatttcgttgcacctaggtttgataattgttgcacctaggttgaataattgaagcaccttagtgccatattcgttgcacctaggtgcaacgaaagaaaactactaatgagaatgaatattgcttcaaatagaatacttatttagtagtaaattccactaaaaaaataatggttctgaatctgttgctattgattcagaaccatataattaatataattcccgactagacaggtgaataattactcaatttcgtccggccaaagacaaggtttacccgtagctttgactgtaggacgttgggcatcaacttttctcaaataggttcctaattctttagaaagccgtttcacaatatccggatgttgtgcgctgagatcattactttcgcctatatcatcggggatattgaatagttcttttttacctgtaccatagtaatagattaatttccagtcacccttgcgtacggcacagttaaagttgattcccggaccgtcgttaccccagttgttgggcatattccagaagaggctgcgtcctttggaaggattaccggtctgtttcagtaaaggcatgaagctgatgccgtcgataggctgaactgtcttgtattttttgatgcccgccatttcgaggatagtaggatagaagtcttctatcagcagatagtcattgcatttgctgccaggggctacgacaccgggccagctgacgatcatcggttcacggataccgccttcataggtggagcctttaccactgttgagaggatgattctgggtgtgcagtttgccgtcacgccaatacgattcggcggcaagtcctccgttgtcgctcatgaaaatgataatggtgttgtcggcttctccgcttttttccagccagttcatcaggtcgcccagactcttgtccatgccttcgatcagtgtggcgtatgcggcttcatggtcggtcatgccttttttcttgtatttgtcgtagaaacgtttgtccttgtccaatgggacgtggatggcatattgggacatatacaggtagaaaggctggttgtacttcttggctttgttcagagctttgatggcttccagagttaatgcttcggtgacgaaggtctccgtaccccagtacttttcaagtccgggaacagccatgagtgatattggctttccgtctttgttgtgaccgtaattctcttctcccagatagctggcgagtcctccggcagcatgtccggctatgtttacttcgaagccccagtggtgcgggtcttctcccggagtgtctatggcaccgaaatgtgcttttccgcaatgaatcgtatgatagccgctgtctttcagcagttgtacgaaggaggttcctacgaatgtgttgttggtgccgggcacttggcttactccgttgtagttccagtccggcacatccagtactttgtccttgcggtctgtctttgtgttcttttgcggcgtccagttggttacgcggtggcgtgccgcgttcgttccggtgatgaggctgcatcgggtgggggaactgatactgctggcatacgcttgtgtgaacatcatgccttgtttggcaagtcgttccatgttgggtgtttcgtacagcttattgtaatctgtcttttgtgtccagaaggggagtgaagtgtcttgccatcccatgtcgtctaccatgaaaaggatgatgttggggcgtttgtccacacgctgtgtctgggcagacttctgtgtttgcaggccggtggcagccagtggcacgagtgcgagggggaaaagtatttttttgttcatggattaattatttagtgttatttcattatttcaattctgccggcctttttgatcggtatgctccgtaattcctgtttcccgtgggagtctgcccatattcttaatgtaccggtgcagtggacatccaatatcagcttatcggtagtacgtttgagtatctgcacagtggcaggcgacaggtatttttcttgtatgccgatcactgcccaacctttacggatggggcaaagatggaacagactatctgtaaatccggataactttatttttctttcagatgcgttcaatacttcggcgctctgtttttcccagttgaatgcgagaatgctgtcgcaagaagaatctgcggatttgccggtgctttcccgtaacaggtaatcttcccgtttgacgaaactttctacttcccgataagcgggagaagtgttcagattgtagcaaatgactgagagcgcttcgtctcctgtaggggcaaatacacggtaggctttaccgctttgcaggggattggtcagtatggattccggagtcgggacggcgggagccgccggacggaatatctttccggtttcatcaatcagggggcggatattgtcggcaataaattcgcctggagagtcggacaggtaaacaggtccgccggagatcgctttcgagcgtgccatcagactgccgcaaacggtatcgcaggaatgaaacatatcgtggtcgggccagacggtctgccccagtatgagtgtattggtatatgactggaacagatgtgatttagccatatcctcgtcatatttcttatagtcgatgctggcacgggttacgctgctgtacaaggtatggtcaatgttcagcacattttgtgccatgcagttcatcagtcccatttgcatccgatgtgtctgatgttccagggcaagattgcagtctttagcctgtcggataacctgcgttccgcccatatagagcgggagggtaaaggattgattgtctatcttcaagaagtcaaatccatattccttcatggtacggacataatattcgtaccatgtttctatcttttctgtactggtgccgggcagtaaactgccgttgtaggagtgtagaacttgctggatttccggcggaaagtcattctcggcagagattcccatccaatagccggaaaggctgtaccatagccctatccatcggattttatctgcttgtttgcgcttcatgatgcggctccatccgttcggaaaacgttttttgtcggggacgagactggtcagttgccggttcttgttcgctatgtgtccgtcgtcaattaagacataacgtaccggtatgccggatgcttcgatggcatcgatatcgttcagtattttcgtttcatcaatgtcataatgataatgttcccaagtacaccatcccagatagtcgaaagcattgaaatactgtttgtccgctcttttgcggagggcagatacggctttgtctgcgattaacgaatcgtaggcgtcactgaatacatggtagacggatgaagatttccggaaaatcaggagggggagtcggccggtcagtgcatcttctcctagtgtggagacatacaatgtgagtgtgccgtcctgattaacctgaaaccagctgaggctgttgctacccgcaatggctttggcgaacagatattctccgtctgcaagttcaaggagcagtgcgtcgcccgatgcggacggcagggcattggaaggaatgcttgcataatcgctccgtgtgaggtcttcgagatggttgaacatccaagggagcaaccgattggtgttattcggccattgatagtcgccggggcgggaatcacggctgaagaatatgccacgaacatacaaaggaagtgcaaccttatacgaaagagtgctttggtgttccggcacttgttgttcgtataaaatgggggtggatggagtatgggtgttcaggtcgatgatttcttccatccgataagctgcaacatctttgtatgtcttccctttatggtagataaacgggttctgtgcagacagcgatgcttccgcaaagatgcccgtcaatagccataaacagatgtggatcattcttctcatgcctcttgtgttattttacggaataggcgctgaagttgataatatccggcagtgcgatagattcggatacggtcagtcttaatgctgtggcttctaccggttcaaacttttcgattcgtttgtgccccacggattctcctttgcagactgtttgccatttaccgttcactttggcttctatctgatattgccggatgcgttctccgtttttgatgttttcctggatgatgcagtaattgacaggctgctcctttccaagtttcagtgtcaggcttttcttttgtcccgaaatgcgggctatcggggaggagaaccgccgattgatttcatctcccatttctttcaggcgctgtgcgtctccggcagggattaatccggtcgggtcaggagttaatccgagaatgagggtggcgtttcttcctactgacttttcatatttgtccatcagcgtgtttagcggatagatgttgttctcgtcatccggttcccagaaccattcgtggcggccgtttgctccccgtagcggagtgtccgccatcgctggtacccagtatttaccgttcttatcaccgtgttttaacagttcgagctggtcgatactgctttcaatgcgtttatggtgtgagcaggggacgggaaaggtagaccagcagggatattccactgtacctgtctccgaacctccccaacggaagtcggcacggtcgatgttatgatagaaaaggcagtttggctgatacttgttgacaatcggttccacgtcggggccatcggcacggggatcatcggctccgccgtcaaaccatatcatatataaatctccgtagcgggtgcagagttctgttaccattttctcgcacaggcgcttgtaccatgcctggcggttgcgggcgaacgctccttctccttcggccttgaagttatggatgcccagcagggagttccatcggataccgatatagatgcccggttgcagaccatatttgcggcaggagttgacgaagtcacggacaatgtctccttttccgtctctccattttacggctttcaggcaataagggttgacgtcgctttgccaaagtccgaaacctgtttcgtgggtggcggtcagtacggcaaatttgcatccggcagctttggcggcttgtacccattggtcagtgttcagttcggtcgggttgaagatgttgtaatcttcgatgggattgatacggttgttgccttgtccgtagcggatgccgtcaaacacgtgcaggtcataatggaagacagctcccatttctgcctcatgccatttgagttgatggggcttggggacggggatagcctgttgttgtgcgaagctgcaaactgagtataggataaaaagagagagatagcaaagtttcttcatggtgtttatttagttacggtttcgagataatgggcaaatgaatcgttggtatggagtagccatgccttgagttgtttgttgaattgccggaccagacggggggattgtccggcaatattatccatttgatatgggtctttggttcggtcgtaaagaactgtttcgtctatttttccattggttgcgtggactgcgaatgtgtgggttgacgtacgtagcccgcggtatccggtggcatgattgtcaaactgtacataataataaggttgtaccacttcttttttactcttgcccagaatatggcgggataagtcgaaagtctgtaccgtttcgggtatttccttccggaatcccatcagggaaaggagggaaggatataagtcggcgaaagcgatcatcaaatggtcgtctttgcgtggctttatctttgccggccatgagataatcatggggatgcgcatggattcttcgtagaagatatcctttccggcattgttgtgagctcccatgcagatgccatgatcggaagtaaatacaatgatggtattctcaaacagtccgttgcttttgagggtttcgatgatacgtcctacctgctcgtctacccctgtgatacaggcgtaataattgcgtatgttatttctgaaatagtttcccatttcggttcctttggcgggtatgtcggggcggtgggcacagagggcttccacatctatatccttatatagggctttgtatttgtcgggaaccagttcgtaaccggtatgcggaggattcatcgatacgaccagtgcgaaaggttgtttattctctttttgtgtctgaatgtattcgatggctttgtccgcttcgtatgcagggccccattggttgacgtagtagaaactgtcacgtggagcagtcgtgtcccagtacatcggtttcagatgataatcgtatgtcccgtaggctgtccagtattcaaatccgtggcggcgttcgggcggacaccattcgttccacgctactttgccacgattgttgtaagtgtctacataaggcttgtaaggagaatccagatgccattttcctatgtatcccgtacggtagttcatgtcttttagtacatcactccaacagcgggcctcctgtggaagctccactccgtaaggtgctgtttgtgaattgcagttgcctgttactttattatgcagggggtacatgcccgtcatcagcatggcacgggcgggtgatgaaacaggataactgctgactgcattagtgaataagactccttcggaagccagatgatccaggcaaggagtctttacaggttctttgcccagacaacctagtgcgtctccccgatactggtctgccatgatgaagacaagattcggagacgtctgggcggcaagcggaagaaccggaacgacgagtgtagctccgatgaaccatttatgataatatgtactctttggtatgtgcattatcataaaaatttctcctttgtgtctgacaggttaagataaactaaggtcattgtattttatttaaaaggtgtacatcaggttgttgtatggctgcaaatgtacgcaaacaatgtggttccgaatatgcctgtttctttcattcaacatacatgtttaattcataagtccatttctttattcgtttttttgtatgttctgacttaatttcgtttatttgccctaaattgtctaatagaatgaagcacttaagtctaatcctcattatcctgattctgagttgttgcccgctgcatcctgcctatgctttttttgataaagatattcggctgctgacaatgagggacggattggcggataacacgattccttgcatctataaagatgaagacggatttatgtggtttgggacggataacggattaagccgttatgacggcaaaacaattcagaacttcaagcctgcgaatacatatgtttcgattgctgccattgtgcgactgtcagatgactttttaggaattgtatccgatggatacctttattatttcaaccggaagcgggaaacttttcttccgatacatactgaatcagatactgccataggtgtatttaatgtcctgcccgctgacgattcttctttttggggaatatcgggaaacagactgatactctgtcaatgggagatacaacaaggaaaggaagaagaaaaaacggctgttcgggtacgcatacaaaagacctttcagttattggaagaaaaaggagaagtcttttcttctctgtgctatcatgaaaaagccgggagcggaatatggctgacaactaaccggggtaatctgatcttgtttcatccggatactccgggggcgtatcagaagataccgctgacagacggaaaaccattacaagtcacttccatcttgaacagagacggagttgtctgggtttctaccatcggcaaaggcattgtccgttatcacacgaagtcggggcatatggaccggatttcgtacggcgggacaggaaaagagaatctcctttctcatacagatgtttatcagactatatttatcggcaataaccgctatctggcagtgacatggggtggctatacactgttgatgccggatgaaaagcagccggaagaactgacgtcggagatatataacaatacgcatacacagatttaccgaaacctcgaaacacgtatgatttctgcctgttacgatcctaatggccttctttggattggtactaacggtggaggagtgatgtattctgatttgaggtcacagttttatgaccgttactatcaggacaggcataacgaaatatgtgatatcctcatggatgatagtcatcgattatggttggcgacctatcacaaaggaatcatgcgaagtgacataccgtacgcaaaagggaaaaaacttagtttctctaaagtcgatacaggtagcgggaaatcggaagaaacgatgttgtgtgccttgaaagatgtagacggcaatctgtggtttggaaatataaacggtacgttgactgtttatcatgtccggaccggtcgttttgtgatccattcgctgttggtagacggtgttgccaacagggcttcggtatgggctttgtatatggacgataagaacaggctctatgtaggtacggaagacgggcttttattgtataaccgtcagacaggtatatgcgttaaattatcagcagcacattatttaaatgagaaaagacaacctttcattcgtgcgattgctcagacaaaagatggaacgatatggctggggaccagtaatatgggagtttgcagagtagttgaatctgcttccggaggtatctccgtagaaaatggatatgagcagaagatgaacatggaatatcgttcggtacgttcgttgctggcatcttcggatgggaatttatatataggttatacggatggctttgccatcctgtctccacgacagaacacgatcagtgcccgttataccacgaatgacggactgtgcagtaattttatcggctgcatagcggaagacagcgaagggcatatctggctgggaagcaactccggcatatcgcggtatggtcgtcgtcagcatctcttttacaattactacatagcaggtagtaaccgttctgccttattcagtgacaagactttgtttttcggaaataatcagagtctgacttatttcaatccggaggatataaatgcctatccgaccaacggacgggtgttaataaccggtttggaagtggataaccatcctgtcgggactggagaaaagattaataatcagatcatcctcaatcaattcatcccttttacggatcgcattgtactggataatgataacaaagatttctccttgactttcaacaacctgtcctactcggacgaacaacaaaaatataattaccggcttttgccttatcaggggaattggctgatttctgatgagggagagaaagcctcgtataccaacctcccagccggtgagtatgtatttgaagtgaagaatatacatccgaacggtcagacaggggcggtgacttcgctgaagatcataattctacctcattggagtcagacttttgctttccggcttttcgtttccctgttattgttgggaggagtggcttatggagtacggttgatcagactacggcagaaacggatggaacacgaaatgcagatgaagcatgaactgttgacggtcagtatggagcgtgagaaagaacgtcagatacgtgtggaacgcgagaacttctttacgggcgttgcccacgaactgcgtactccgctgactttaatccttgccccgttacaggaattgatgaaacagtgcaatccattggatgacttttataagaaattgcaggtcatgtataagaatgcagcctcactgcacaccttggtcgatcagttgctttatgtacaaaagatagaggccgggatggtcagactccagttatccgagactgatttggtacagttggtctgcaatgtgtcggaaccgttccggcagatggctgaaatcaaaggtttgcaatttgatattgatttgcccgaagggaagttcctgtattgggtagatgagggaaagatcgcttcggccgtgcaaaaccttctttcaaatgcgtttaagtataccccttcgggagggcgtgtcttgctttctgtctctcatctgatgaaaagtgggcagggttattgccggatcaccgtttcggatacaggtgcagggattccggaatggttgcagaaacatgcttttgaatcgttcgtaacgggagataatgtacctgagatgtcaacgaaggcaggaataggattgcatattgtgaagaacacgatggacttgcatcatggattggtaacgctgaagagtgtgccggacgaaggaagtatctttgccctttatattcccgaaggcaaagagcattttgcaaaagattcttatgaacttattgacagccatcagggaaaaacaaagcaaaatgaagagctgaaaccggaaccgtttcttccaataccggaaaacaaaatacaggaaacagcggctaaaaagagtctgctgatcatcgaagataatgaagatgtccgcgaatatatccggagcttattcatttccagatatgccgtcagtgaagcttgcaatggtgaggaaggggtgcggatagccaaagaacagttgcccgatcttattatctcggatgtaatgatgcccgtaaaggacggctttacttgttgcagggaaattcgtatgcagcaggaaaccgcgcatattcctatcttgatactgactgccagagcagaagatgctgacatcctgcaaggctgtaatagcggagcggatgattatatgatgaaaccctttaatccggagatattaaagaccaaagtggataacctgattttgcagcgtgagcgattgaagcggatttatacgaaagccctgatgctgaaacaggaatcggaagagggggagaaagaagatgccttcttgcaacaactgattcatatcatagaagctaacctttccaatgcggactttaatgtaaaaatgttggcggagcaactgaatatgagtcagcctaccttgtaccggaaggtgaaacagcgcagtgatttgtctgttatagatatgattcgcagtatacgtataagcaaggcggcgacattgattctggagaatcgctattctattcaggaaatttcggaaatggttggttattccgatacccgtactttgcgcaagcacttcatggagcagttcggcgtatctccttctaaatatatgggtagtactgattgataacctacaagtcgatattatatagtttcaacttattatataatgtctttcggtcgatattcagtaattgtgccgctttgctcttgttatttccggtttggcgcaatgcctccagaatgtgttctttctctgtttcttcgttgcgtagcgccatgcttgcggaacaaacggtacttgtttccagtaattcggttcctaactcaagaagagtgatgaaactgccttgtgccagtaaggtcgctctttttacgatattcttcatttggcgtaagttgcccggccagtgataattgagtaaggcttgtgaggctttcgagtcaaaaccgatcagatgcttgtccagttccttgtttgcctgatcgaggaagaagttggcaaacaacaggatatcctctttccgttctttcaggtcgggcatccgcagggtaaattcattgatgcgatggaaaaggtcttcacggaaagtacctttctcgatagcctgttccagattctcgttggtggcggataccagacggatatcaaccgatacctcttgcgtggaaccgaccggacgaatctttctctcttgcaaggcacggagaagttgtatctgtacctcgtaactgagatttcctatttcatccaggaagatagtgcctccattggcggcaacgaacgctccggtcttgtccgtcagtgctcctgtaaaagagcccttcacatggccgaaaaactcggatgcagctaattctttgggaatcgaaccgcagtctaccgcgataaacggcttgtcattccgtttgctcagttgatggatgcggtgcgccacatactctttccccgttccgctggaaccgttgatcagtacggacatattggtgggagctaccagacctacataattatagagttgcttggcggcatcactttctccttccagataagcatgatgggtttcggtggcgtttccggacgaaatggaagaacctttctttgcagaagttttggctgcggtatgcgtagtcggcgcttctttcgcttgcaaagcttctgacatctttttgagtagttcctccggattcaccggtttggcaacataatcgcgtgctcccagtttcatcgcttgtactgccgattggatatcggcataaccggtcatgatgatcaaaggaatatcgattcctttttcgttcatccatttcagaagatcgattccgtcgtgatccggtaagcgtaaatcggacaggattaagtctgccccttgtccttcaatgtgcttctgggcacgggcaatgttactgactgacgacacctcaaacccttttttacttagccaggttttcagcatcattccgaaagtgatatcgtcttctattatcaatatggatttcatcatactctcttttgcctcttttaatgctacaaaggtaagaggatttgggcgaaagtagtatatttgcaaacttaaattaaataaaagtgttatgaaaaagattgcatacttactattaaccatatcgttttgcggacttacggcctgcaaaaccggaacaaaaaaaggaggaaatatggacaacgaaacgttggtaaagattgaaacaaccttgggagacatcaaggttaagttgtataatgagacgccgaaacatcgtgataatttcattaagctggcagaagacggcgtttatgaaggaacgctattccaccgtgttatcaaagactttatgattcaggcaggtgacccggattcaaagaatgcaccgaaaggaaagatgctgggtgcaggagatgtgggttacacccttccggccgaatttgtttatccgaagtattttcacaaaaaaggcgctttgtctgctgcccgtcagggagacaatgtaaatccgaagaaagaatcatccggttgccagttctacattgtgacaggcaaggtgtacaacgactctacattgctgggcatggaaagccagatgaatgagaataagatcaatgttattttcaatacgttggctcagaagcacatgaaagaaatctataagatgcggaaggaaaacgatgaaaacggtttgtatgaattgcaggagaagctttttgcagaggcggaagcggaagctgccaagcaaccggaatttcactttacgccggaacagatcgaagcttatacgactgtaggaggtactcctcatctggacggtgagtatacggttttcggtgaagtaatcgaaggcatggacatcgtggataagattcagcaggtgaaaaccgaccgtagcgaccgccccgaagaggacgtgaagattgtaaaagtagaagtactggattaagtagaatgaagattaacaggcatattttggacaatgggttacgtctggtacattcgcaggacgaaagtacgcagatggtagctcttaatgtattatataatgtgggagcccgcgacgaacatcccgagcatacaggctttgctcatttgttcgaacacctgatgttcggaggttcggtgaacattcccgattatgatatgccgctgcaactggcaggcggcgagaataatgcctggaccaataatgacataaccaattactacctcactgtaccccggcagaatgtagagaccggcttttggctggaatccgaccgtatgctgagccttgatttcagtgaacggagtctggaagtacagcgtggagtagtaatggaagaattcaagcagcgttgcctgaaccagccttacggagacgtcggtcatcttttgcgtcctctggcatatcgggcgcatacttatcagtggcctaccatcggaaaagatttgtcgcacatagccaatgcgacgctggaagaggtgaaagcattcttcttccgtttttatgcgccgaacaatgcagtgctcgccgtaacgggaaatatctcttttgaggaagcagttgcattgacggaaaaatggttcggtcccatccctcgcagggaggttcctcaacggaatctgccgcaggaaccggagcagacagaagaacgacggttgacagtagagcgtaacgtaccccttgattcactattcatggcgtatcatatgtgcagtcatgatcatccggattattacgcttttgatatattgtcggatttgttgagcaacggacgttccagtcgtctgaatcaacgcctggtacagcaaaaacaactgttttcgagtattgacgcttatatttccggtagtgtggatgccggattgttccatatctcgggcaaacccgcggcaggtgtttcgctggaacaggcggaagcggccgtacgtgaagaactggaacgtttgcagcaagaacctgttgacgaacaggaactggaaaaagtgaagaataaattcgaatcgacgcagatattcggcaatatcaattatttgaatgtcgctaccaatcttgcttggtttgaactgttgggcagggcggaagatatggaaaaggaggtagagcgttatcgcgctgttactgccggacaattgcaaaaggtagctcagtctgctttcaggaaggagaatggagtgatactttattataagaaacaaatatcctgacttctccttaccggcgggatatttattggaggcaacggcaggatgcggagttgccggaatatgcgattaactacggaaaaataaatgagaaatatctatagtatatataaggagcattacaaagcactgatttctctcggattgcccattgtaatcgggcaaataggagttattgtgctggggtttgccgatacgttgatgatcggtcatcatagtacgatagaactgggtgctgcttccttcgtcaataatgtattcaatctggtgattattttcagtacaggcttctcgtacgggctgactcctatcgtgggaggtttgtatggaactcatcagtatgcttcggcggggcaggcgttgcgtaacagcctgctggcaaatttgttggtggcattcttgcttaccatcggtatgactgtcctttattttaatgtgggaaatctgggacagccggaagaacttattcccctgataaaaccttattatctggttctgctggcttcgctcgtctttgtgatgctgttcaatggcttcaagcagtttacggatggaattacggatactaagaccgctatgtggatattgctcggcggaaatgtgctgaatattatcggcaattatatcctgatatacggaaagctgggcttgccggaaatgggcttgctgggagcaggtatcagtacgctgttctcgcgtatcatgatggtagtcgtatttatcatagtctttatgcggagtccgcgttttcttcgttttaagctcggcttctatcgtctgggatggtcgaaggctatattcggacgattgaattcgctgggttggccgattgcttttcagatgggaatggagacagcttcgttcagtctgagtgcggtgatgattggctggctgggtaccattgcgctggcttctcatcaggtcatgctggctatttctcagtttacgtttatgatgtattacgggatgggagcagctgtggctgtccgtgtgagtaactttaacgggcagggcgatatactcaatgtacgtcgttcggcttatgccggttttcatttgatgatggcgttgggtgttgtgctttcttccatcgtattcctctgccgcaattatctgggaggttggtttaccgatagtaccgaagtggcggctatggtaacttcgcttatccttccgttccttgtatatcagtttggagatggattgcagataacctttgccaatgccttgcgtggaatctcagatgtaaaactgatgatgctgattgccttcattgcttatttccttatttcgcttccggtcggctatttttgcggattcgtgttggagtgggggatcataggtgtctggatggcatttccttttgggttgaccagtgccggtctgatgttatggtggcgtttccatcacaagacgaaactaccgccttccattcaaaattcataatttaaaatcttaattgcctatggcttcctttcgctccaccaaactgaaaataaccatcggctatatattgctgctggcgattcttcttttttctctggtgtttgtgcatcaggagatggagacgctgtcggctgcggacgatcagcagaatctgcggacagacagtctgctgagtcttctccatgagaaagatcagaatacccttcagatgctgcgggtgctgagcgaggcgaatgatagcttgctttccgcctcggagattgaagaaatcatatcagaacagcaggactcggtgattactcagcaacgggtacaacaccgggttattaccaaacgcgattctctgatcactaccccgaagaagaaaggcttcttcaaacgattgggggaagtgttcgcgccttctaagaaagatactgccgtgctggtcaatacttctctggaaattgccaccgatacgatattggaacctgtcaagtcggcggactcccttcagcataagattcgcatggctaccgaagagaaacggttgcagcggaggcgaacgatccggcgtaccagtacgaggtatcagcggatgaatacacagctgaccgcaagaatggatagtctgataaaaggatacgaggaggaaatgtctgcgcgtgcccgtcaggatgcggaacttcagcaagaggtgcggatgcgttcggctaatatcattgccggaattgccattggtgccgtattcttatccgcctttttcctgatcttaattatgcgggatattactcgtagcaaccgttatcggcgtcagctcgaagaagcgaataagcgggcggaagacttgcttgttgcccgtgagaaactgatgcttgccattacccatgactttaaggcgccattaggctcgataatgggatatacggaactcttgtcccgcctgaccgaagatgaacggcagcgattctatctggacaacatgaaaagttcttcagagcatttactgaagttagtaagcgacttgcttgatttccaccgtcttgacctcaataaagcggaagtgaaccggattgtttttaatcctgctcagctgtttgaagaaatccgtgtttgctttgaacctctgacggcggctaaaggcttggtcttgcaatgtcatatcgctccggaattgtcggagaaatatatcagtgatcctttacgtattcagcagatagtgaataatctcttgtccaatgcggtgaaattcactcagcagggcaagatcacattaactgttggttataacgcttcgaagctgacaatagcggttgcggataccggcaaagggatggcatcggaagaccgggaacgcatcttccaggaatttacccgcctccccggtgcgcagggagaagaaggattcggactgggattgtccattgtgcataagctggttcttctgcttgaaggtacgatcgatgtacaaagcacgttaggaaaaggaagttgctttactgtcgtgttgccactctttccggtgggcaagtcaatagtggaaaataaacctttcgggagcagaattaagaaaccatcgaaagatacggatgtttctccggaagagacagatgccgtaccggccatgaaggtgatccgtgtgcttctgattgatgatgataagattcagctgaacctgactgctgccatgctgaaacagcacaacatcgatgctgtttgctgcgagcagttggaagaactgatagagcaactgcgctcttcgacgtttgatgtactgctgaccgatatacagatgcctgctatcaacggttttgatctggtcaaattattgcgtgcctctaacattccgcaagcccgcaatattcctgttattgctgtcacggcacgtagcgaaatggatgagaaggctttgcatgaacatggctttgccggatgcctgcacaaaccttttacggtgaaagaattgctggtaactctgaatgaaggacaaatgtcagctgatgaggcgcatataacacatgatatgcaattgattgcagatgcgctgcctgaagatactttattcaacttttctgcactgactgccttctcggaagatgatccggaagcggcgtgttctattatccggacttttatcgaagagaccggcaagaatgccgaccggatgcaacaggcattaactgacagggaggtggatggaatagccgctatggctcataaactccttccgcttttcaccttgatcggagcttctgagtctgttgcttcattaagatggctggagtcttgccggggggaagaattctccgaagaaatagaaaagactacgttggagactttggaggcggtgcgtaaagttgttcgtgctgctgaggagtatagtttcggtttacattaaatctctctcggcagctcctttggaacagcctatatagtgccatgcttgtgccaccctgttggcacagttgtgccaaaggcatgtcacagtcgtgccactgcggtggcacaagcgtgccaacgtagtggcacgggcataagctcgtagcatagtgagaaggtgctgccttgacaaatatctcaccttccgaatgaacggaatgaacgggatgaaattgcgctaaatgcaaccataacctccggctttttcacattttagcttttggacaaaccttttttcaaagtaatttgtttactttgtatcacttttacactgacacatcctgcatgaaacgaaaatggataagacgggtgggctggatattgcttactcctataatactttttgtaatactgatggtattactttatatacctcctgttcagaatcttttgcgacgggaggttactgcgtatgcttctaaagcaaccggaatgcagattcaggtggaacggatagaccttcgttttccgcttaatctgctggtacgaggggtggaggtcatacagcagccggataccttattgtctttggaaagcctgaatgtccgcgtacaggcatggccattgctcaaaggaaaagtagaagttgacgaggttaccttaagtcaggtggcggtcaattctgccaatctgatagaggggatgcagataaaaggcgttttgggacgcttctttctgcaaagtcatggagtcgatttatcgaacgaaacggcagttgtcaatcggacagagttatccgatactcatatacaacttctgatgactgataccacgaccactcccaaagatacgacggcatctgctcctgtgaactggaaggtgaaccttcatcaactgaagttgaagaatgtatcattcggtatgaaactgcctgccgactccatgaagatggcggcatacataggcgaagcgaccattgatgacgccaaagcggatttaaagaaccagttttatggattgaagcaattccttttgtcgggtgcctctgccagttatgacactggagaggcccaaccgtcggaaggttttgacgcctctcatatggcagtccggaatatccgcatcggattggactctctgctctacgaaggcagaaatatgaacgctgtgattcgtgaaataacgatggaagagcgttcgggactgagtattacttcactgacagggcggctcttttcgaatgattctatcatccgcattcctgaactgaaactgcaaaccccacattcagaaatagacctgtccgcccagacttattgggaactcgtaaatatcccgacgacaggacgtttatccgccagctttaacgcacatataggcaaagaggacgtgatgctttttgccggcggactgcctcaaacgtttaaagaagcatatccgttccgtccgttagtgattcgtgccggtacagatggaaatctgaaagagatgcagatttcgcgcttcacggtagacttgccgggagctttctcgctaaaggggggaggaatccttgaaaacctgacggacagtctgactcgttcgggaactattgggctggatatggttacccggaatctgaacttcctgacaggattgactggagtcacacccgatggctctttagtaattcccgacagtatgagtctcaagatgaagatggagatgaacggcccgcagtataaagcaaaactcgatctgaaagaaggtaagggcagcatgaatgtaaatgctgcattaaacagttcgacagaagtttatacggccgatctgaaaataaacgatctgcaactgcatcattttctcccgaaagactcgatttatgaactatctctttcggcagatgccaagggcaggggactggatgtcatgtcctttcattctttagccaatctgaatctttctttggaccagcttcattacgcccgctatcatctttcgaatgttcatttgacgggaaatcttaaaggagctttggcaacggctcagcttacgagtgacaatgaacttttgaaaatgacggcggatgcagaatataatttagctcatagctatccagacggtaaagtgacagttgacgttactcagcttgatttgtacgaactgggacttatgcccaagccgatgaaacatccgttggcattcaatttaagcggagaggcacggcagaaccgtgttttcactcatttcaccgccggtgatatgaaactgaatctgagtgcccgtgccggtgtatatcctctgattcgtcagtctacccattttgtagatgtgttgatgaagcaggtggatgaaaaactcttggatcatgctgctttgcgtgaagcattgccgtcggctattttctctttctcggcaggaaaggagaatccgttggcatactatatggcaatgaagaatatatcgttccatgatgcttccatgaaattcggcactgctcccgattggggaatcaacggcaaagcagccatccatgctttgaaagtggataccttgcaactggatacggtctttttcaccgtcaaacaggatactacccgtatgaatctccgtgccggagtaatcaacggaccgaagaatccccagttttccttctccactattctgacaggcgagattcgcgaccgcgatgccgagctgctggcagaatataagaacgaaaaggggaaaaccggtgtgttgcttggagtcaatgcccgtccgctggttggaggacgtggaaaaggggatggactggcttttacactgattccggaagaaccgattattgcgttccgtaaattccacttcaacgaagatcataactggatttatctgcataagaatatgcgcgtgtatgccaatgtggatatgtgggatgatgaaggtatgggcttccgtgtgcattcggtacagggagatacggtttctttgcagaatatcgatgtcgaaatccggagaatccgcttggatgaaataacgagcgtactgccttacttccccgaaatcaccggattgttctcggcagaagcacactatatacagaccgaaaaggaccttcagctctctgcagaagcatccattgatgaactgacttatgaacgccagcgcattggtgacattactttgggagctacatggctgccgggcgaacagggaaaacaatacctcaacgcttatctgaatcatgataaggtagaagtgctgatagcagatggcaagctgctccctacctcgacgggaaaggatagcctggaagtaaatacgacgttggaacacttcccgcttcgtattgccaacgcctttattcccgacgagctggttacgcttgccggtgatatggacggtgacctgaatataacaggcagtaccgagcagccattgataaacggtgaactgatactggacagcgtatctgtcctgtcacgccagtatggtgctaacttcctgtttgataaccgccctgtgcagttgaagaacaatcgtctgatatttgataagttcgccatttacaccacgggaaagaatccgtttacgatcgacggttatgtcgatttccgtgatatgtcccgaccgatggcgagtctgaatctgctggcggaaaactataccttgttgaatgcgaagcgtactcgcgaaagccttgtctacggaaaagtctttgcggacttgcgggcaaccataaaaggcccgttggacgggttgaatatgcgtggaaacctgaatttgctgggcaatacggatgtctcgtatgtactgaccgattcaccgctgaccgtgcaggatcgtctgggaagtctggtgacatttacttcattcagtgataccaccacagttgtccgtcaggaagtgcctaccgtatctttaggtggattggatatgctgatgatggttcatatcgacccttcagtcagggtgaaagtggacttggacgccagtgacaatcgtatcgaactggaaggaggtggcgatctttcgatgaaatacactccgcagggagacctgacattgaccggacgttacacactgagcggtggactgatgaagtattctctgcctatcattgcagtcaaggaatttgccatcgataacggcagctatgtagattggaccggaaacccgatggaccccatgctgaacttcaaggcaactgaccgtatccgtgcttccgtatccgaaggagagaacggaggaacgagaatggttaactttgacgtttccattgtcgtaaagaaccggttggacaacctgtcttttgctttcgacgtagcggccccggaagatgcgaccatacagaatgaactgacagcaatgggagcggaagaacgtggaaaacaggcactttatatcatgttgatgaaaacctatctcggcaccggaccgatcggcggtggaggcggcggacttggcaagttgaatatgggttctgccctgaactccgtactgagcagtcagataaattcactgatgggtaacctgaagaatgccagcgtctctgtgggtgtcgaagatcatgacgcctcggataccggcggcaagcgtacggattacagtttccgttattcgcagcgcctcttcaataaccgcttccagattgtaatcggtggtaaggtatcgacgggcgaaaatgcgacgaatgatgccgaatccttcattgacaacatctctttggaatatcgtctggaccgtacgggaacccgttatgtccgtttgttctacgataagaactatgagagtgtactcgaaggggagattacggaaaccggagtcggtctggtacttcgcaagaaactggataagctcagtgaactgttcatctttaagaaaaagaagtaagaatgaaagatatacgtattaacatattagcaggctgtcttataggtatagtgttgttttcggcgtgttcggtgacgaaacatctgcccgaagatgaaatactctataccggaggaaaaacggtgatagtcaataaatcatcgacacgggttggtgaaactgctttgacggaaatcaatgcagcgcttgccaaaactcccagtactactctgttgggaggttttctgcctattccttttaaaatgtggatgtataacgacttcgtgaaatacaagaaaggattcggtaagtggatgtttaaccgctttgccgccaatccgcccgtatttatttctactgtcaatcccgaagtacgtgtcaaggtagccactaacctgctccgtgattacggatatttcaatggaaaggtgacttacgagactttggtcgataagaaagatagtctgaaagcaagtctgctctatacggtagatatgaagaacccttatttcattgatacagtgtattatcagcgtttcactccccagactctgaagatcatggaacgcggacgtcgtatgtcttacatcacccccggcgaacagtttaatgtggtggatttggatgaagaacgttcccgtatcagtacccttttgcgtaatcggggatatttctacttccgtccggactatatgacctatcaggcagatacaaccttggttcccggcggacatatcagtcttcgtctgattcctcttccgggattaccggctgccgctcaacgttcttactatgtaggagatgcttcggtctatctcttcggaaagaatggcgaggcacctaatgacagtatcttgtacaagaatctgaatattcactattatgataaactgcaggtccgtccgaatatgctctatcgatggatgaactatcagcagtttgtacggagcaaacagatgagggcttccaaccgtacccgtctttatagccagtaccggcaggagcaggtgcaggagaaattgagtcagctcggtatattcagctatatggatatgcaatatgctccccgagatacgacagcggcttgtgatacactggatgtcactatgcaggctacatttgccaaaccgttggatgcagaactggaactgaatgtagtaacgaagagtaatgaccagaccggtcccggtgcatctttcggtgtcactcgtaacaatgtattcggaggtggtgaaagctggaacgtaaaactgaaaggctcttatgagtggcagaccggaggcggtgagaagagctcactgatgaacagttgggaaatggggctttctacctctctgacttttccgagagtcgtgttcccgcatctgggtaaacgggagtttgacttcccggccacgacgacctttcgtctgtatatcaaccagctgaaccgggcaaagtattataaactgctgtcctttggcggcaatgctacatacgatttccagccctcccgtaccagccggcatagtattactccttttaaactgacatttaatgtcttgcagcatcagtctgaggattttaaagagatagctgaagctaatcctgcattgtatgtcagtcttaggaaccagtttattccggcgatggaatatacgtatacgtatgacaatgcttcgggtcgtcggataaagaaccctatctggtggcagtctaccgtcacttcggcgggtaatatcacttcccttatttaccgtgcttttggcaagccgttcaatgaagaggataagagtttgctgggggctccgtttgcacagtttgtgaagttgaatacagagttgcgtcatttgtggaacatagataagaataatgcgatagccagccgcatggcagtaggtgcactgtttacttatggcaatgctacgatagctccctatagtgaacaattttatgtaggtggtgccaatagtatccgtgcttttacagtgcgcagtgtcggtccgggcggttatcatccggaagagggaaaatattcctacctggatcagacaggaaccttccgctttgaggcgaatgtggaatatcgtttccgtattttcaagagcttttggggagctacctttctggatgcaggaaatgtgtggttgttgcgcaaagacagaaagcttttggctgatggaaaagaagcacgtcccaattcacaactgcgtctgaagactttccctaaacaaatagctttgggaacgggtgtcggtatccgttatgacatggatattctcgtattccgtctcgacttcggtattcctctgcatctgccttatgatacggaacgtagcggctattataatgtaaccggagctttcttcaagaatctgggaatacattttgctatcggttacccgttctaatgaatgatttttgtacgattttagtgaataatgattgatatttgtcctgttggattcaactatttttgtaaatttgcaacgaaatctgatgccattgacatcactaaccttttaatattacacaatttatgaaaccaactttattcttattggctgctggtatgggtagccgttatggaggcttgaagcaattggacggactgggtcctaacggcgaaactattatggattactctatctatgatgctatcaacgcaggatttggtaagcttgtatttgtaatccgcaaagattttgaacaggatttccgcgaaaagattatttctaaatacgaaggccacattccttgcgaactggtattccagtctattgatgatcttccggaaggattcacttgtccggcagaccgtacaaaaccatggggtacaaatcatgcggtaatgatgggagctgatgtgattagtgaaccgtttgcggtaatcaactgcgatgacttctatggtcgtgactcgttccaggtaatgggcaaattcctgtctgctcttcccgaaaattccaagaatgtttattcaatggtaggtttccgtgtgggaaatacgttgagcgagagcggtacggtatctcgtggtatctgcagtacagatgctaacaacttgctgacttccgtagtggaacgtacgaagattcaacgtctggacggcgaagtaaaatacatcgatgataacggtgaatggacagctactcctgatacgactccggtaagtatgaacttctggggctttactcccgactactttgcttacagtgaagagttcttcaagactttcctgagcgatccgaagaacatggagaacctgaagagcgaattctttatcccgctgatggtggataaattgattaacgacggaactgcaactgtagaagttctggatactaccagcaaatggtttggtgtaacttatccggaagaccgtcagagcgtagtggataagattcaggcattggtagatgccggtgaataccctgctaaattgttctaaagaaaagcttttgataaagaccaggaagcagtcattcatgagaatgactgctttttttgtctttcataacggataatactgccctttatccaataattattcattatctttgcaatccaaaatcttataaatcagagacagacgtgatttcagtagaaggattatcagtagaatttaatgcgacaccgctctttgcggatgtcagctatgttatcaataaaaaagaccgcatcgctttggtcggcaagaatggtgcgggcaaatcgactatgttgaaaatattggcaggtctgcaaaacccgacccgtggagtggtagccgtccctaaagatgtaacaatcggctatctgccgcaagtcatgatcctttcggatgtccgcacggtgatggaggaagcagaactcgctttcgagcatattttcgaacttcaggcaaaccttgaacggatgaatcagcagcttgccgaccgcaccgactatgaatccgaagaataccaccagttaatagaccgcttcacacacgaaaacgaccgcttcctgatgatgggaggaaccaattttcaggcggaaatagaacgtaccctgttgggattgggctttagcagggaagactttaaccgttcgacttccgaattctccggcggctggcgtatgcgtatcgaactagcgaagctcttgctccgtcgtccggatgtgctgctccttgatgagccgactaaccatctggatatcgagagtatacaatggctggagaactttctgtctacccgtgccaatgctgttgtgctggtcagccacgaccgtgctttccttaataatgtaactacccgtacgatcgagattacctgcggtcagatttatgactataaagtgaagtacgatgagtttgtcgtattacgtaaagaacgtcgtgagcagcagctccgtgcctatgagaatcagcagaagcagatacaggatacggaagactttatcgaacgtttccgctataaggcaaccaaagccgtacaggtgcagagtcgtatcaaacaactggaaaagatagaccgtatcgaggtcgatgaggaagacaactcttccctccgtctgaaatttcctcctgccagccgcagcgggaattatccggttatctgtgaagacgtacgcaaggcatacggacagcacgttgttttccatgatgtgaatctgacgatcaacagaggagaaaaagtcgcatttgtcggaaagaacggagaaggtaaatctacgttagtgaaatgtatcatgggcgagattgattttgatggtaaactgacgatcgggcataacgtgcagatcggttactttgcacagaatcaggcgcagatgctggatgaaaacatgacggtatttgatacgatcgaccgtgtggcgacaggagatatccggttgaagatacgtgacattttgggtgcattcatgtttggcggagaggcttcggataaaaaagtgaaagtactttccggtggagagcgtactcgtctggctatgattaagttgctgctggaaccggtgaacttcctgattttggacgaacctaccaatcatttggatatgcgttccaaagatgtactgaaagaagctatccgcgaatttgacggaacagtgatacttgtcagccacgaccgtgattttttggacggacttgcgactaaagtatatgagttcggtggtggaacagtgaaagaacatcttggcggtatctacgatttcctgcaaaagaagaagatcgacagcctgaatgaacttcagaaaggagtttctctctctacttctcctaccgcatctgccaaaggaaacgaagcggatacagagcaaccttcggagaacagactctcgtatgaagcgcagaaggaactcaataagaagataaagaagttggaacgccaggtggcggactgtgaggcttcgattgaagaaacggaatcggcaatcgccattctggaagcaaaaatggcaaccccggaaggagcatcggatatgcaactgtatgaacggcatcagaagctgaaacagcaattggataccaccgttgaagagtgggaacgggtttcgatggaactggaagaagtgaaaaactaatttattatataatatgaaagtaaccaagtatttaccaattcttgccgtatgccttatgacaacaggatgtaatagcaagaaagaggccgtactaacgtccggtatcgaccttgctaatctggataccacggcaatgccgggtacaagtttttatcagtatgcctgcggtgggtggattgaaagtcatccgctgacagacgagtattcacgcttcggctctttcgatatgcttcacgagaaaagccgcgaacagttgaaagaactgattgcagaactggctgcaaagaaagacaacgctccgggcagtgctgcccagaaagtgggtgatctttataacatcgctatggacagcgtgaagctgaacaaagaaggagcagctccgatcaaagaagaaatggcggctatcgatgcgctcaaagataaagaagagatttacacttacattgccgaaagtcagaagaaaggaatacgtccttactttaccatgtttgttagtgcggatgatatgaacagctctatgaacatggttcagacctatcagggcggtctcggaatgggacagcgtgattactatctggagaatgacgagcagacaaagagtatccgcgataaatataaggagcacctcgttaaaatgttccagttggccggctatgacgaagctaccgcacagaaagcaatggtggctgtgatgaacatcgaaacacgtcttgccaaagctgcccgttcacaagtagaattgcgtgatccgcatgccaactataataagatggatatggaaacgctgaaaaagaacttccctactttcaactgggatgcttatttcactacttcgggactgaatgacttgaaagaagtgaatatcggtcagcctgcagccatgaaggaagttgccgatgttattaatacagtgcctcttgaagaccagaagttctatcttcaatggaatctgatcgatgccgcagcctctttccttagtgatgatttcgtagcacaaaacttcgacttctatagtagaacaatgtctggcaagaaagaaatgcagcctcgctggaaacgtgcggtaagcactgtagacggctctttgggtgaagtagtaggacagatgtatgtcgagaaatacttccctgccgctgccaaagaacgtatggttggattggtgaagaatttgcagacttctctgggcgaacgcatcaaagcgctggaatggatgagcgaaccgacaaaggtgaaagcattagagaaactggctactttccatgtaaagatcggttacccggataaatggaaagattactctgctctggagatcaaagacgactcttattgggcaaatatcgagcgtgccagccaatgggacttcaatgacatgatcgcgaaagccggtaagccggtcgacaaggacgaatggttgatgacacctcagacagtaaatgcttactataacccgacaaccaacgaaatctgtttcccagccgctatcctgcaggctccgttctttgatatgaacgctgacgatgcgatgaactatggtgctatcggtgtggtaatcggccatgaaatgactcacggattcgacgatcagggtcgtcaatacgacaaggatggtaacctgaaagactggtggacagaagaagatgctaaaaagttcgaggaacgtgctcaagtgatggttaacttctttgacagcatagaagtggctcccggtgtacatgcaaacggtgaacttactttgggagagaacattgccgaccacggtggcttgcaggtttctttcgcggctttcaagaaagcaatggaaacagcaccgctggaagttgttgacggatttactcccgaacaacgtttcttccttgcttatgctaatgtatgggccggacacatccgcccggaagagattctccgactgaccaaactcgatcctcactctttaggaaaatggcgtgtggacggagcattgcctcatatccagaactggtacgaagcattcaatatcacagaacatgatcctatgttcgtagcgaaggataaacgagtgtctatctggtaatatattttgattagaagctctatgtgcgaaggagcgttgactttccaacaggaacagtcaacgcttttttttattaattcacaccttatttattacgtacgataaacaatatttcgtaactttgcgcatcaaatacttaataagcaattcaatgtcagagtctaaaagaataaaaactgcattggtatctgtataccataaggaaggtttggatgaaattattaccaaactttacgaagaaggagtcgagtttctctcaacaggtggaactcgtcagtttattgaatcactaggatatccctgtaaggcagtggaagatttgaccacttatccttccatccttggtggtagagtgaagacattacatccgaagattttcggaggtatcctttgccgtcgtgacctggaacaggatattcaacagattgaaaagtatgaaatccccgaaatagatttggttattgtcgacctgtatccgtttgaagctaccgtagcttccggcgcatccgaagcagacatcattgaaaaaatcgatataggtggaatctctttgattcgtgctgctgccaagaactataacgatgtcatcatcgtggcttctcaggcacaatataagccattgctggatatgctgatggaacatggcgctacttcttcactcgaagaacgtcgctggatggcaaaagaagcgtttgccgtttcttctcactacgactcagctatcttcaattatttcgatgccggcgaaggttctgctttccgttgttcggtaaacaaccagaagcaactccgttacggtgaaaaccctcatcagaaaggttatttctacggaaatctggacgccatgttcgatcagattcacggtaaggaaatctcttataacaacttgctggacatcaatgctgccgtcgatctgatcgacgaatacgaagatttgactttcgctatcctgaaacataataatgcttgcggcctggcttctcgtccaactgtactggaagcatggacagacgcgttggccggtgatcccgtttccgctttcggaggcgtattgattactaacggagtgattgacaaagcagcagctgaagagatcaacaagatattcttcgaagtgattatcgcgccggactatgacgtagacgcgctcgagattttgggacagaaaaagaaccgcatcatcctggttcgcaaagaagccaaactgcctaagaaacagttccgtgctttgttgaacggtgtattggtgcaggacaaagatatgaatattgaaacggttgccgatctgagaactgtgacagacaaagctcctactccggaagaagtggaagatctgttgtttgccaacaagatcgttaagaacagtaaatcaaacgctatcgtgctggcaaaaggcaaacagcttcttgcaagcggtgtgggacagacttcacgggtagacgccttgaaacaagcgattgaaaaagccaaatcattcggattcgatctgaacggtgcggtaatggcttcagatgctttcttccccttcccggattgcgtagaaatagcagacaaagaaggtattacggcagtcatccagccgggcggctcggtgaaagacgatcttacttttgcttactgcaacgagcacggtatggcgatggtgaccaccggtatccgtcattttaaacattaaaaacaggtattgagtattaggtattaagtattaaccttgcggataaggcagtctactttatacctaatatttaatacctaatacttaatacttaatactttatattaatgggattattctcttttacacaagaaatagcgatggacttggggacagccaataccatcatcatcacaaacgggaaaattgtggtggatgagccttcggttgtggccttggatcgccgtacagataagatgatcgccgttggggaaaaggcgaagttgatgcacgaaaagacccacgaaaatatacgtactattcgtccgttgagggatggagtgatcgccgacttctatgcttgcgagcaaatgatgcgcggtttgattaagcaggtaaatactcgtaatcacttgttttcgccgtcacttcgtatggtgatcggtgtaccgtcgggaagtacggaagtagaactccgtgccgttcgtgactcagccgagcatgccggtgggcgtgacgtctatctgatattcgaaccgatggctgcggcaatcggtatcggtattgatgtagaagcgcccgaaggaaacatgatcgtggatataggtggtgggtctacggaaattgccgttatctctttgggaggtatcgtttccaacaactctatccgtatcgccggtgatgatctgactgcggatatccaggaatacatgagccgtcagcataatgtgaaagtcagcgaacgtatggcagaacgtattaagatcaacgtaggtgccgcactgaccgagcttggcgatgacgctccggaagattacatcgttcatggaccgaaccgtatcacagctcttccgatggaagtgcccgtatgttatcaggaagtggctcactgtctggagaaatccatctccaaggttgaaacagccatcttgagtgcattggaaaatacgccgcccgaactgtatgcggatattgtacacaacggtatttatcttgccggtggtggtgcattgcttcgcggactggacaagcgtttgacagataaaattaacatacctttccacattgctgaagatcctttgcacgcagtagccaaaggtacgggtgtggcattaaagaatgtagaccgtttctctttcttgatgagataaataatacggatcattattcatgcggaatttaataaacttccttttgaaatacaattactggttcctcttcatcgtattagaggtagccagttttgttttgttatttcggttcaacaactatcagcagagtactttttttacatctgccaatgtcgttgtgggggcagtttatgaagtttcgggaggaataagctcttatttccatctcaaatcggtcaacgcagacttgctggatcgtaatatggtgctcgaacagcagatcactaatctggaaaaggcgttgcgggagcatcaggttgattcggtcactgtaaacagcatcaaggagatacctctgacagattatcagttgttcaaggcacacgtcattaagaacagtctgaatcaggcggataattatataacgctcgatcagggttcttcttccggcatccgtcccgaaatgggagtggtggacggaaacggaatagtgggcattgtctatgaaacctcctcttcgtattcactcgtgatttcggtattgaacagcaagtcaaatattagttgcaagattgtcggaagtgactactttggttatctgaagtgggagcatggagattcccgttatgcgtatctgaaagatttgcctcgtcatgcagagtttaatctgggtgatacggtggtgacaagcggcttctctaccgtattccctgaaggaatcatggtaggaacagtcgatgatatgtccgactcgcacgacggattgtcttatttgctgaaaatcaagttggctaccgatttcggcaaggtgagtgatgtgcgggtgatagcccggaacggtcagcaggaacagaaagaactggaaaataaggctgtgaaataatgataattacctatatacatagaatcggatggtttatcgggctggtacttcttcaggtactgatcctgaataacgtacatattgccggatatgctactccctttctctacatttactttatactgaaattcgcttccggaacttcccggaatgagttgatgttgtgggctttcttcttcggactaaccattgatatctttgccgatactccggggatgaatgctgcggcaaccgtgctgctggctttccttcgtccgtccttgctgcgcctgtttactccgcgtgacaatctggacagtatcatcccttctttcaagagcatgggcatcactcctttcctgaaatataccacggcaagtgtttttgtccatagcctggcattactcagcattgagttcttctcatttaccagcatctggctgttgttattgcgggtgatttcgtgcacccttctgactttaacctgcattcttgctgtagaaggaataaggagataggaatggcaaaagactatagattagaaaagcggaaatttgttatcggggggattgctttaactattgtgttgatttatctgatacgcctctttgtattgcagataacgacagacgactacaagaagaatgccgacagcaatgctttcctgaataaaattcaatatccctcacggggtgctatttacgaccgtaacggcaaactgctggtattcaaccagccggcctatgacatcactcttgtcccgaaagaggtcgaaaatctggatacactcgatttatgtgagtcgttgggcattactcgtgctcagttccttaagatcatgagtgatatgagagaccgccgccgcaatccgggatattcccgatataccaaccagctgttcatgtcacaactctctgcggaggagtgcggtgtcttccaggagaaactgttcaagtttcccggtttttatattcagcggcgtacgatccggcaatattcatacaatgctgccgcccatgctttgggggatatcggtgaggtatccgttaaagatatggaggcggatgaagagggatactacatccgcggagattatgtaggaaaactgggagttgaaagatcgtacgagaaatacctgcgtggagaaaagggagtagagattctgttgcgcgatgcgcatggacgtatccagggacgttatatggacggagagtatgaccgtccttccattccgggcaagaatctgactctgagtctcgacatcgatttgcagatattaggcgaacggttattgaaaaataagattggaagtatcgtagctatcgaaccggaaaccggagaaatcctttgtctggtttcttctccgaattatgatccgcatctgatgattggtcgtcagcgtggcaagaaccatctgatgctgcaacgcgataaacagaaaccgttgctcaatcgtgcgttgatgggagtctatcctccggggtcaactttcaagacggcacagggactgaccttcctgcaagaaggaatcattaccgagcaaagtccttctttcccctgttctcgtggtttccattatgggcgtctgacagtgggatgtcatgctcacggctcacctttgccattgattccggctattgcgacttcttgcaactcctatttctgttgggggctgttccgtatgttcggcgatcgcaagtacggttcaccgcagaatgccatcacagtctggaaagatcacatggtttctcagggattcggctataagttaggagttgatttgcccggagagaaacggggcttgataccgaacgcgcaattttatgacaaggcttatcgtggacactggaacggactgacggtcatcagtatctccatcggacaaggtgaaattctgtctacccctcttcagatagctaacttaggggcaacgattgccaatcgcggacattttacaacaccacatattgtgaaggaaattcaggatgcgcagttggatagcatttatcgacatccacgcaacacaaccatagagcgaagacattatgaatctgtggtagaaggaatgcgtgctgctgccaccggaggtacttgccgtatgctgtccgtgatggtgccggaacttgaagcctgcggaaagacaggaacagcgcagaatcgcggacatgaccattcggtgtttatgggctttgctccgatgaaccagcctaagatcgccattgccgtatatgtagagaatggaggttggggagcgacttatggagtgccgatcggtgcattgatgatggaacaatatatgaaagggaagttgtcgcccgagaatgagttaagagcagaagaaatcagtaacagaatcatcttatatggtaacgaggaacgatagtttgtggaaaacactggattgggtaacgattggtatctatctgcttttgattgtcggcggatggttcagcgtttgcggtgccagctatgactatggcgatcgtgacttctttgatttctctacccgtgccggaaagcagtttgtatggattatctgctcctttggtttgggatttgttttgctgatgctggaagaccggatgtatgatatgttcgcgtacattatatatgtagggatgattgtgctgcttattgttaccatctttatcgcaccggatacgaaaggatcgcgttcttggctggtgatgggaccggtcagcctgcaacccgccgagtttgccaagtttgctacggcactggcgctggcgaaatatatgaactcatactcattcagcataaagaaagaaaagtgtgccttcgtcttgggctttatcattcttcttccgatgctcctgattatcggacagcgggagacggggtcagcattagtctatcttgccttctttttggtgctttatcgggaaggaatgcccggtgtagtgctttttgccggtttgtgtgcagtgatttactttgttgtcggcatccgttttgacgaggtctttattgccgatactcccacaccgttgggcgaatttatcgtgttgttattgattctgttgtttgccggaggaatggtatgggtgtaccccaaaaagtgggaacccacacggaacattatcggaggaagcctgatcattctgcttatcgcatatttaatatcggaatacggaatacacttcagtctggtatgggtgcaatgggggctttgtgttcttgtggtaggttatctgctctatctggcattgagagagcgtcaacgttcctatttcctgattgccctgtttgccatcggctctatcggctttctgtattccagtaactacgtatttgataacatcttggaatcccatcagcaaatccgtatcaaggttgtactcggtatggaagaagacctgacgggagcaggatataatgtcaatcagtcaaagatagccatcggttccggtggattgaccggaaaaggctttctgaatggcacacagacgaaactgaaatatgtgcccgaacaagatactgactttatcttctgcacagtgggagaggagcagggatttgtcggttcggctgctgttctgttggctttccttatattgattctgagactgattgctttatccgagcggcagacttccacttttgcacgtgtctatggatattccgttgtcagtattttccttttccatctttttattaatgtcgggatggtgcttgggctgactccggtaattggtattcctttgccgttcttcagttacggaggttcttccttgtggggattcaccattttattgtttatcttcctgaggctggatgccggaagaggcagaaggctttaatctattctccttgtttttcaatccggataccgacgtcattgagtccggttaatttctcatcctgcattccgtgcacaatcttaactgtgtagtttccgggatgcagcgggcggacagatttgacaaaaactgctgtttgatagatacttccccacccattgcctgtccatcttcctgtggaatcagccaggttgaccgctatcgtgtcagtgcgccatactgtggagtcgagcagattctcatgaatgaataagtaaaggttgcggtaagggtattcacttctgttgcgaacttccgcaaataatctgagtgtaccaggaatactgtccgtaacaggacactgaaaagagagtgtatcactctttccccatccctcattgggcagggactggtaggagtgatacacggtattttcattacaggctgccatgaggcaggcaccgaataaacaaaataagctattcctgagcaggcttttcattattttgcggtttctcttgattcgaatttctttcaggtctgggaatacgttcctggttgggttgtcttccttgttcctgcgggcgttcctgattttgaggacgttcctgtttgggttgccgttctctattctgcggacgctcttgattacgttcttgattgcgttcctgatttaccggacgctcttgattttgtgaacgctcttgattctgcggacggttcggattctgtggacgttcctgattctgtcctctttccggacgtctgttctcattattccgtccttgattctgtcctctgttccggttattattgttattgtttctcggacgattttctctgtctcctctttctcctctgttgccgttctctgacggttggggacgattctcgttctcccccctctgaggttgctgcggacgatttccactttcggcctgtgcctgcgggcggttgtcattatttccttttctcttcttcttgttccggttaccgttgtttccgtccttattatttcggttacggtcgaagcgggtgaggctttcctgttccagcaagtcaatcggctttttggattcttgcttcacttcagcttcgagcagactatccggtttcattcctttcttgttcatggcaattacctcaaaggcacgttttccactgattgttaccagattggcggggaagttcttgtccgtagagtaagaaacatgattactcagaatatcagccttgaagaagtagaaagtgccgtcctttgtttccagttcgatttctttggaagggaggcgcttctgagcttccacatagcagtccacctcatagttgagacaacactttaactttgcgcactgtccggcaagcttttgaggattcagtgaaatgtcctgaaagcgggcggcacttgtagataccgatacaaagctcgtcatccaagtagcgcagcaaagctcccgtccgcaaggaccgatacctccgatacgtcctgcttcctgtcgtgcaccgatttgtttcatttcaatgcggacacggaaagcttcggcaagtaccttaatcagttggcggaagtccacacgttcgtcagcaatgtagtagaagatggccttattgccgtcgccctgatattccacatcaccgattttcatatccaggttcaggttcagtgcgatctggcgggcacggatcatggtcgcatgttcctttgctttcgcttcgttgaatttctccatatccaccggttttgctttccggtagattctctttatttcaacatcagtcttgaagttggccttcttcatttgcagcgggacgagtcttcccgtcagggtcacgacgccgatgtcatggcccggagcagcttctacggcaacgatgtctcccttttccagtttgatcttattgctgttgcggtaatagccttttcgggtgtttttaaattgcacttccaccatatcacactcttccgcgttgcctggtatgtctgccagccaatcgtaagtgttcagtttcttatcttgtcgggagcatcctttgcagcaaagaccgccgctcccattatgaagcttatattccatagtttatatatttattattgcttcaacagtacgatcatcttcagagagaagtcgaaaaataccatcttggcatttacattttgttctatatgcagttgcgcttcgcttagttcatccatgatgcctattacgttcctttcgttgacgaaaggagcaaagcgagaggcgaaattctgttcgttgattgtcatgtatgtcagatcacgctgatggagattgaatataaagttttcgcggatcatgcgctggcagtattccagaaagttcttctggcgttcacgtcccatgccggcaacctgttcgctccagagcttcatttccctgattttccgttgataggacaatcgcatcaggctgacaaataagtcgaagaagagctgattctcttcattcagatgaatagtttccagtgctttgataaagttcccgtttgccagatgggcaatggaaaggctgtcggcaggctggataccgtatttggactgcaatacgcggtcgatggccggttcgtctatttttcgcacgttcatgcgttgagtacggctcagaatagtaggcagaatcatttccggagcttccgatacgagcaggaagatagttttctcaggtggctcttcgagcaatttcaataatttgttggcacataccggatgcatcttttcgggcaaccagagaatcgtgatcttgaatcctccttcgctcgatttgaggctgagtttcttcaggatttcatcgctctcttttgcgtagatgatggcctgtgcattctcggcatccatttctctcagccagtgattcaggttgaagtacggattcttcagaacgaatggtctccagtcggcgatatagtcgtcgcacacttcccgttttcctttagaacttttcacgatggggaatacgaaatgtacgtccggatgtaccagtttattgaatttcacacacgacggacatactccgcaggcatccgtctcaccccggttggtgcaactgatgtagcgggcataagcgatagccagcggcatcttaccgactccttcggggccacagatcagttgggcatgcggtatgcgcccttcactcacttcctgaatgagtcgttgcttgatttcttcttgtccgattacgtctctgaaaaacatatcaataaatgattttagccacttctttgatactgtccactgctccgatggagtagaagtggatgcttggcactccatgtgccattaactctttgcattgggcgacacaccattcgataccaacctgttcggcttccttgtcgttcttgcatttcaaagcctccttgaccaaatcttccggcaagtctactttgaatgtcttgggcaccatgctgagttgagataacttcttgaatggcttgatgcccggaatgataggtacattgatacctgctgccttcgcttgctctacaaattcgaagtatttcttattgtcgtagaataactgtgtcacagcatattccgcacctgcttctactttctttttcagccagaagagatcggattcgatgttgggagcctcctcgtgcttctccggatagcaagccacaccgtaggagaacgggctgttggttactttcatctccgaaccgtctacaaagattcccttattgaagttattgatttgctcctgcaactcgatagcatgatggtatccgtcgccctcgggagtgaatactgattcatgtttggccttatctccccgaagtaccagcagatcggtgatattgaggaattgcaggtcgagcagtacatattcggtttcttcacgggtgaagccgctgcacagtatgtgcggaaccaccgttatattatacttgttctggatagcggcagctacggcaacagtccccgggcgtcttctcagccggtttcgctggaaaagtccgttgcccagatccttatatacgtattcgctgcgatgcgtggtgatattgatatatttcggatcaaactcccgaagggtatcgacagtctgatacagcttttcgatgcctgtacctttcagtggaggaaggatttcgaaagagaaagctgttttttcgctgttatgtattaaatcaattactctcattctttttcgttgatgttcgttgtctacttgaattaaaagtgcatattgggacaaaaatacgaaaaaagaaagatttcttcttgatttgtttgaaaatagtttggtttttatcgcactattacataaaagtggggatggataaaataaaacggacccttatttagagtgttccaggaaattctccagagcggcgatcttgtcattccgcagatattgcatatccatgaccggaatgtagctgtaagggataaactgtaacaatctcactgctgcgaatttcttgtcagccgacatgaggacatccagccgaagatttccgcctgttcctttctcaatattgatattgttagaaaaattgcctgattcgatcatttctttcaatggttcaaggtatttcagattgaaagaatagttcttctctttgaccacgcttttagtcagcagatatctcatttccctggaacggaatttaagttggtatatgccaagcagacagagtaatatattgccgataagatataatatgctatctaaagaaatgccgtccataatgaggaggatcgcttcaggtaagtgacataatcctattaataaaacaataactccgatgattgttttttttacgttgaatcgttgtctgatatcctgattggatgaactatcagttcttgataattgatttgccatagtcttttctttttatactctttatacctattttctatgcacttatgattaagtgtggttgcaaatgtaggaggaatcaactgaaatgcggtgttccattcaggacgaaaattgttcaaaaggagactaaaggagtataaacttcggggtcgttttcgcatatatttgtgaaaaaaggcaatcttgaagagagaatgttttgatattctctttttaagactgcctttcgctcattctctgacgagtcggaaattacttgtcgagaaatgattttttcattctggcaatgtcagtcaggtaatcctgaagatcttgttcatgctcttcttcttcagcaaggatatgcttggcaatgtcgcaagtagtgaaatcttttccattggtaaagtcagcaatttcctgataacgcagtattgcgcaacgctcagaagctacattatcttttagcagacttacagaatcaaacccttggggagcatcatatttgcatcttgccagttcgaaccatttcttcgggtccaatacgggtactccttccagttcgataatgcggtcggcaagcagttgcgcatgtctgcgttcttcttccgcatgttcttcgaattcgccttgtacatctgcacgcatggcgccttctactactaatgcacctacccagtattggtaatatgccaaccattcttcggacaatgctgcattcaactgtgaaatcaagctttctacatcaagctttccttgtaagatttttacgctttctctagccataatttaaaagtttaggttactatattcaagtcgggtatgtaacagacgggagatgtttttgtttgagagttagcagtgatttaacagtgattttatatatgcatggtatgcaagcgttgaaatgagatttctcctgtaatatataagtgtacaagatagaaaaatgccaatatggcagatagattgattgatttaggggtggatgttcgtgtgccatttggtattcttttttttgtgttcggtaaccgggaatgcttgcttcatgctgaatcaagcacaaccggtttgctaagacaaatgattgaagcatcaatagcaggcaaataataagagtagattcaaggcgagtatattttctgcttactatgaattaaacacgtgttttgctcccatgctctcactttttgcttgtatcgtcttattcatcgttgttacagctgttgtagcaagtgttgtagcagtgtgggagcaggcatttgctctcactctatatccatgctttaatacactttttacttgatgttgtggtttgatattcagcgtgttaatgtctgatagcccctcttttgttgtctgtactgtattggatttagttgacaacctcgatgaagcgttagtttcctcggaggaaacggcagttccctttaaaaggaacggtcgtttccattaaaaggaacgcccgttccctcaccgggaaacgacagtttccattccaagaaatgataggaaactataagttattgatgtgtactggttttagttgacaacttcgtttgttataactgaattagtttactcaatatactttaatatctaaaataaattctttaatattcaataagtttgctcactttataagtcttgcactttacataacatattacttgtcataatcgaagttatgataagctactcataattttgaagggtgacatgagtctgattggtcctcgtcctgatccgttagattggctggacaagtataaagaggaagagaaggtcttcctgaatgtgcatcccggaatcactggctataatcaggcatactatcgtaatagttccgatgcacaggagaagattgacaatgacgtgtattacgcaaagaacatcagtttcgcccttgatgtgaagataattttgaaaaccatcaagacagtgttgttccgcgagaatgttaatgtaacaagagaataattactatgcgagaatacggaagtgagcatcctgccattgtgctcccagatggctattttgagtcgatggaggaatatggtcgtgaggtgttgttcatgagaagtggtcgtgaagctttgctgttggcagcaatagctgcttctacagaaaaagacaaaacgatactctttcctgcctactgctgttggtcaatgagtgcgccttttgagaaggcgggctggaaggtgatttattaccgcctgaaggaagatctgactgtcgatattgactatctgagacaactgttagaaaaggagaagccacaggcaatactgacaatgaacttctatggtagtgcttcgacagacgatgctgtacgtatgattaaggattgcgatgaagacataaaggtcattgaggacttcagtcattgtaccttttcgcttaagttgatacacaatccaaagattaatatatacgtgtcgagcatacgaaaatcgataggtgtgtgtgatggggctgtgatattaagcaaagagccgctacctacccagtacatacaagaggaacaaaaggattttgctgacaagcgctttgtagctcagacggataaggcacgctatacctacagtaaaaatcaagagaagaaaggtgaattcctcagtacaatacgcgagtgtgaagggatcatcaacgagtttacgtctgttcgccctatctcagatcgtgcaagaaagcagttggctcaagtgaatggtgaggagattgcctatgctcgtaggaagaatatgcgccacttgtggtcattgctgaatggcaaggtggagatggttccgggattggaacgatgcatggagggggctccattctcattgcctatccttatagataatcgcgatgaggtgcaaagtaccttggctaaaagaggtatctatacgcagttgttgtggcctatttgcgaggaggctcagcaggtgtgtagcgtgtcgaagatgatggatgctcgaatgctgagtgtacctattgaccaacgatattcatgggatgacattgaggatatggcaggcatcatctgtaatgtgctcaatgtttaggactaaataatataagaatattatgcaaaaaagactattggtattggccgcaggcatcttgcaagtgcctgtcatcaagaaggccaaggatatgggaatatatgtaattgctgccgatggcgatgcgaatgccgtaggtttgcaatatgcagataaagctgtggtggtgaacatcaccagtgaggaggatgtgcttcgtgtagcacgtgaggaacgtattgatggtgtgattcatccttgctcggaggtgagcatgaatgtgatgggtcgtctcaatgaggagttagggttgtcgggcatcaccaagctacaggcgattcgtgcgacgaacaagcatctaatgcgtgaggcatttgagaggggcaatgccccttcgccgaagtctttctgttttgaggatgcaaataaagcttggaagtgtttctgtaaggaattgcctaaggatggtattcttaagccctctcgaaatagtggttcacgtgggattgcaaagatacagaaaggactctctgaggttcagtttgttgaattattcaatcgtgctagagagaaatcacgtgataagagtgttatgcttgagcagtttgttgagggacctgagttctctgtggaaatcattgcttggaatggtgaagtaaatgtgctgacagtaacagataagaagacaacagaggctccctattttgtggagttgggtcataatcagccttcttgtttccctcaatatactgtggattcaattaaggacgctgcagtagctggtgtgaaagctttgggcgtgatgaactgtgcatgccatgcagaggtaaaagttcagaacggtgaggcttatatcatggagattggagctcgccttggtggtgatttcatttctactgaattgacccatttgagtacgggtgtagatatggtggctgctgctatcaattgcgcactcggtatagcgccatgtcttgagccttcagaggagaaacatggagtctgcatccgctatttctgcccgaagcctggaaaattggtaagtatacagaacgccgaggtgctggatgattctcgtgtgtatctctgggagatttaccacaaggagggcgatatgattccagaggtgacgagcagtctatgcagaagcggtcacgtgattgtgaccgaagagactccccaaaaagccattgcgttggcggagagattgattaacgaagtaaagatggagacagtatgaaagcagtattcccctgttcatattacttgcctgagacggcagcaagcctctacttgacggacaacatcgttcatgcttgtgccgagcaggacttagaggtggatctatacacgcctacccctacgcgagctgtgccagagggtgcaaaatggaagcgatatgaaacagatgtggatggcaagttgcgcatccaccggttccatttgtatggcgagggtaaaaatcctattttgagagcattgcgctatgtgataggtgaggcgatgttacttcactactgtatatggaagaaatatgatgttgcgtttatcgattcgactccaccaatacaaggattaaagatgccactgattaagtggctgaagcgaaagccaacggtatataatgctcaggatatttttcctgactccctagtgaacaacggactgtcgaaggggggggggcttgtatggaaaattggtcgtatcgtggagaagattacctacaaatatgcagataagattatcgtaatttctgaggacttcaagaaaaatcttttgacgaagggtgttcctgaggagaagattgttgtggtgtataattgggtggatcagaatgcagtggtagatattccgagggagaagaacaaactgttcgagatgtatggattagacaggagtaaattctatgtcacatataacggcaacattgggttgtctcagaacatggatatgctgctaagtgtggctgaggagttaaaaacatccaattctgacatccactttgttcttgtgggtacgggggtttatttggacgaggtgaagagaatggtggctgagagaaatatagataatgtacatatacttccattccaaccatatgaggatattagtcatgtattctcgttgggtgatgcgtctctcgtgatttctaagcccggaacaggttcggcatctgtaccttcaaagacatggagcatcatgtcggcaagtcgtcctgtactggccaatttcgatgagaatgaactcaagagcatccttgaagataatagctgtggcatcttcactaaggcgggcgataaagaggagtttaagaagtcgatacttacactgtatctcaatcgcgaactctgtaaagagtacggcaagaacggtcgtcagttcgtattgaataatctcactcgcgaggtgggtacacagaagtatgtggatgtgataaagtctgtagtgaaagactaatgaatgaattatttttcgagttactccagttgctataggtacgcgcgatgtattgtcgcatgttccttcggcaatggaatggcaggagataaatgagctttcggaaaagcaagggctaacaggtatttcgtttcatggtaggcaaaggctgtataaggaatactctgagcaaactgtctatttgctcatcggcctgaaaatgcagtggcttggaatggaagcatacattcaggaagaaaacttgttggtggatgagcgttgtgaggagactactcgtatgctagcggaggatagttttaggagttgtattctgaaggagcaagctaatgcctgctattatccacagcccaagttacgtacttcaggaaatattgatatatggggcaggcccattgcctcgaagggtttgtttgaagatagaaagctagtgactaagtatttgataaacagggaggatgactatatccgtatgcagtaccatcacattgactatcatatattccccgatgtggaagtgtatttctgccctatagtgctgttcaactatcgtaagaatgagcgtttgcaaaacaagttcggaagcggaatggatggaaataagaatagaaacaaatttgatcaataacttaaaaaacaaataacaaatgagtataaatttgagaagaaggaatattcctttttcgcctccagatatgacggaagctgaagctaatgaagttcgtgatgcaatcctgagtggttggattacgactggtcctcgtactaagaaactggagaagataatttctgaatacgttcacacagataagacggtatgtctgaactctgctacggctgccatggagatggtgttgcgtgtgttgggtgtggggcctggcgatgagattatcatgcctgcatacacttatacagcatcagcttcggttgttcagcatgtaggtgctaccatcgtgatggtagactcgcagaaggacaatgttgagatggactacgagacgttggctgcagctatcacggaacgcactaaggtgattgttcctgttgacttggctggtatttgtgcagatgtggataagatcaaggagattgtgactcgtcctgagattttggcaaaattcactcctaagaatgatatacagaaattgattggtcgcatcgtggtgtctaacgattgtgcgcactcgtttggcgcttctcgccacggcaagatggcaggtgagattgcggacttctcttcattctcattccatgcggtgaagaacttcacgacagcagagggtggcgcaatgacttggaacttggctttcggtagtgagaaggtagagcgtcagcagatgtattgcggaagtcttgtgccgtttatcgaggatgaaagctggaatgagttcatttaccgcctctcacaactcttctctctccatggtcagaacaaggatgcattggctaagactaagttaggtgcatgggagtacgacattatcggcccatggtacaagtgcaacatgacagacataatggctgctatgggtttggtacagttcgaacgctattctgagatgctgaagaagcgtgaagagtatgtggcctatatgaataaggctattgatgatcttaacgctaaccttgacactagccatcaggtagcttatctgaaccataaggctgaggatcattgctcatcgcatcacttgtatctggtgcgtctgcaaggtcgcacccgtgaagaggctaaccatgtaattgggcagatggcagagcgaggcattgctactaatgtacattacaagccacttcctatgatgactgcatacatggctctcggcttcgacatcaagtactatcctaatgcctataacttgttcgagaatgagatcaccctcccgctcaacacttgcatgaccatggaggatgtcgagtatgtgatggagaatttcgtggatatcgtcaaatcgttgtaagctattggcattgtgcccaatttcaaaaaacttatggaaggtatttgcaaaattaacatataccttttctggtctcaaaagacagataagtctcgttacgatgattgtacaactgcaagaaaaaacggataactatgatacacatagataagaaactaatatcagaactgtttgacagggctttggtaaaccctcgccttcgtcatagttttgatctttgtaatccagataatagtgggcagcgtatgctcaatgttcccactcgaagatgtgagcaagttatgaaagagctttgatagaataatttaaccccttaattgatactttattatgattacagaagaattgaaaaaacgagtagctgactttgttgaaatggagtagcgttcgggttcaatgcagttaataacatcaggattacgtcgctcgctgcatgcggattgccgaggaagataccgctgaaactttcgaagcattgaagaagtaatgtttatctgtcagcacaagtagggctaagagagagatttggtggtaatcggatatgtcggttgttcaactctcaaaaatagatggagatgactttgacggaatggcaccggatgatatgttccaacgcttttttgagcatatcttggatgatgacctgctgacactgccggttactttgatgacgatgatcctgacgctctagatgataacctaaagctttctcaaacgacaaaatattcaatgatctctgattctggtgaaggttgtccgcgaccttcattgcaattcttaagttaaagtgtttagggcttctataaattcatcaagaaggaagatatgttcttgaagcgttctgaggagagttatagtaatgttcgctttaatggtgagaaggttgactttgactcttttgaatgggactatttgctgtattagctaggaaaaatgggggtatggctgattaaatatgtatatactataaatgaaatattaatgaataaaatgaaaaagatagctttaatatcaggaatcaccggtcaggatggttcatttttagccgagtttttaatagaaaaaggatatgaagtccatggtatccttcgtcgttcctcttctttcaacaccgcacgtatcgaacatctctatttagatgaatgggtacgtgacatgaaaaaggagcgtttggttaatcttcattatggagatatgacggattccagttccttgatccgtataatccagcaggtacaaccggatgaaatttataacctggccgcacaaagccatgtgaaagtttcttttgatgtaccggagtatacagccgaagcggatgctatcggcacacttcgcatgctggaagctgtccgcatccttggaatggagaagaagacaaggatttatcaggcttccacttctgaactattcggtttggtccaggaagttccacagaaggaaactactccattctatccccgttccccgtatggagtagccaaacaatacggtttttggataaccaagaactatcgtgaaagctatggcatgtatgctgtaaacggaatcctttttaatcatgaaagtgaacgtagaggagagacttttgtaacccgtaagataacattggctgctgcccgtattgcgcaaggtcttcaggacaaactttatttgggaaacttgaactcacttcgtgactggggatacgctaaggactatgttgagtgtatgtggctgatccttcagcatgatactcctgaagattttgtaattgctacgggagaataccacactgtacgtgaatttacgacactggctttcaaagaagtcggtattgaacttcgttgggatggtgaaggtgtgaatgagaaaggcattgatgtatcgacgggagaggttttggttgaagtcgatcctaaatatttccgtcctgctgaagttgagcagttactgggtgatcctagtaaagctcgtacgttacttggctggaatcctaccaagacttctttccccgaactggtaaaaatcatggtatcgcatgatatgaagtttgtgaagaagcttcacatgaaagaactgatgaatagagaagaataagaatggataagaatacgaaaatttatgtagcaggacaccatggtttggtgggttccgctatctggaataatttgcagcgtcgtggttacacgaatcttgtaggacgctctcataaagaactggaccttcttgatggcgtagccgtaaaacaattctttgatgaagaacagcctgatgcagttgtccttgccgctgcgcacgtcggtggtatccttgcaaacttgcagtatcgtgccgattttatctatcagaatctccagattcagcagaatgtgataggggagagcttccgtcataacgtacagaaactgcttttcctgggtagtacctgtatttatccccgtgatgccgcacaaccaatgaaggaagacgttttgttgacttctcctttggaatatacgaacgaaccttatgccattgccaagattgctggtttgaagatgtgtgaaagcttcaatcttcagtatggcacgaactatatcgctgtgatgcctaccaacctttatggtccgaatgataatttccatttggagaacagtcatgttcttcctgccatgattcgcaagattcatctggctaaatgtttaaacgaagatgactggaaggccgttcgtagagaccttgacttgcgtcctgtggaaggtgtgaccggtagtgagtctgatgctggaatattggataaattggcaaaatttggtattactcctgaatcggtaactctttggggtaccggaacacctatgcgtgaattcttatggagtgaagagatggctgatgcgagcgttcatgtactgttgaacgttgatttcaaagatacttatgttacaggcagtagagacattcgtaactgccatatcaatgttggtacaggtaaggaagttagtatccgtgaagttgccgaaataattatgaaggaaattggctttaaaggtatccttctttgggatagttcaaagcctgatggtacaatgcgtaaattaacagatgtatcgaagttacacagtttaggctggcatcataaggttgagattgatgaaggaatcgagcgtctttataaatggtatttgaaaggtgtctaaattttataatttatatattatggaaaaaataaacggaaggaatgttttaatactgttgttgatcctgcttcttacagcttgtcagtcttataaaaaggtgccttacttgcaggatgcagaagtcgttttgtatagtacgcagaacgaacagttatatgatgcaaagatcatgcccaaagacttgttgactattgtagtgtcgtgtaccagtcctgaactggctgcgccttttaatctgacagtggctacgcagagtaatgctgctttgaattatacgactactcagccagtcctacaacaatatctagtggataatgacggtaatataaatttccctgtattaggtgagcttcatgtaggcggattgaccaagaaggcgaccgaacaaatgattgtggaaaagttgaaaccttatattacggaaactcctattgtaacggtacgtatggtaaattataagatttccgtgattggtgaagttgcccgtcccggtacattcacgatttccaatgaaaaggtgaacatcttggaagctttggctatggcaggtgatatgaccgtatatggtctgcgtgatgatgttaagctgatacgggagaatgccaatggcaaacaggaaattattcctttggatctgaataaagcggagactatcctttctccttattattatttgcaacagaatgatattatttacgtaactccgaataaggcaaaagctcgaaattcggatatcggaactagtacaagtttgtggttctctgctacttcgatccttgtttctattgccagtttattgtttaacatcttgaaataaaaagaaagagttatgaaggaagaaaataaaaacgggaaaggacctgaaatgactgaggatcagattgatttccgggcgcttctttttaaatatatcattcactggccctggtttgtaggtgcggtgttgctatgttttgttggcgcgtggttttatttgcattgggctacccccatttataatatttccgctacagttctgataaaagacgagaagaagggtggaggtgcaggactttcttcggaattggaggatatgggtttaagcggcctgatgacttcctctaaaaatattgataatgagttggaggttctgcgttcgaaaaccctggtaaaagaggtggttaatcagttgggactgtatataacttataaagatgaggatgaatttcctgctaaaggtctatataagacatctccggtgcaggtaagcttgacacctcaagaggctgaaaaattgaatgcaccgatgatggtggaaatgactttacagcctgaaggtagtatggatgtgaatgtgactgtgggtgagaagggttatcagaaacattttgaaaagctgcctgctatttttccgactgatgaaggtacattggctttctttcaggaagttgattcggtaactttacagaatggaacgaaagctcctcggatagagaagaacgtacgtcatataactgcgacaataaataaaccgatgagagtggcaaaaggctattgtaacagtctgtctattgctcctacctctaaaacgacttctgttgctgtgatttcattgaagaactccagtttgcagcgtggacaggattttatcaaccagttgcttgagatgtataatcgcaatacgaacaatgataaaaacgaaatcgctcagaagacggctgagtttatcgatgaacgtattggcattatctcaaaagaattgggtagtacggaagctaatctggagactttcaagcgtgatgccggtatcacggatttgacaagtgaagctcagatcgccttggccggtaatgctgagtatgaaaagaagagcgtagagaaccgtactcaaatcagtctggtgaatgacttgcgtaagtatttgcgaggcaatgaatacgaagtattgccgagtaatgtgggtttgcaggatgccgccttgattggagctattgaacgttacaacgagatgttgatggaacgtaaacgcctgttgcgtacatcaacagagaataaccctacgattgtgaatttggatacaagtatccgtgccatgaaagccaatgtacaggctactcttgaaggaaccttgcaggggttgatgatcaccaaagagagccttgaccgtgaggcgagtcgttattcccgtcgtatcagtaacgctccgggacaggaacgtgcttatgtaagtattgcccgtcagcaggagatcaaggccggattgtatctgatgctgttacagaaacgtgaagagaatgcgattgctcttgctgctacagccaataatgcaaaaattatcgatgaagcaatagctgacgatactccggtatctcctaaaggcaaaatgatttatctgattgcattggtgttgggtattggaattcccgtcggtatcatctatttgattgaactgacgaaattcaagatcgaaggtcgtgctgatgtagagaaactgacaagtgtgcctgttgtcggtgatattccattaactgatgagaagaatgataagaatggttctatcgccgtcttcgagaacaagaataatctgatgagtgaaaccttccgtaatattcgtactaatcttcagtttatgctcgataatgatcagaaggtgatccttgtgacctcaactgtcagtggtgaaggaaaatcgtttgtctcgtcgaatttggctatcagtctttctcttttaggaaagaaggtggtgattgtcggactcgatattcgtaagccggggttgaataaagtattccagctctctaataaggagagaggtattactcagtatctttccaatcctgaaacggatttgatggagcttgttcaaccttctgatgtaaataagaatctgtttattcttccgggtggtactgttcctcctaatccaacggaactattagcccgtaacggcctggacagagcgatagaaaccttgaagaagaacttcgattatgtcatccttgatactgctcctatcggcatggtaacagataccttattaataggtcgtgtagcagacttgtcagtttacgtatgccgtgctgactacactcataaggcggaatatacattgatcaatgaactgtcttttgagaagaagctacctaatctttgtaccgtcatcaacggcgtagacctgaagaagcgaaaatacggttattactacggctacggtaagtatggcaaacactacggttatggtaaacgttatggttacggctatggatatggccaagatacaaaaagataaatatctgaatatctatgaattataacttttttcagaaaaagagccccgcaaggggcttttctttttgttatctgaaataaaagcctcacctttgcattgttgatcaacaaaacgtgaataaaataacttgaatttgaatctttaaaaaaacgtattatgagtgtaatttacaaagttgttacgcgaccatctgacccgcgtgttcccaattctcccaagaaatattatccgcatctgatcactttaggtcagtctgtcaatctgaaatatattgcgcagaaaatgcagggctattcttctttatctatcggtgatatcaagagtgtgattcagaattttgtggagaaaatgaaagagcaacttctggaaggtaagtctgtgaatatcgaaggcttgggggtatttatgctgactgcttgttcgaaaggagcggatgcagcgaaagatgtcaatgctaaaagtgtggatagcgtacgcatcttctttcaggcgaataaggaactgcgtatcacgaagacggctacccgtgcagatgaaaaactggatttgatcagtttggatgaatatctgaagaagttgaacgcctctgtgactccgaatgatccggatgatggtgaaaatggcggtggtggaaatgaaggaggaggagatgaggaagctccggatccgactgtataatctgaaaagcttaaaaaagaaaggaggaaaaatctatgaagaaaacttggagtgtagttttgaaagtaatcattgctgtagccggtgcgattgccggagtactgggagtacaggctgcatcattgtaagcagcattcagtaaataaagtaattggttagataagacaggcaggcgggaagaactttcccgcctgctttgttgtatgctaaaatatcaaatagttggcgttactttttcgtgtgcgataacgaaaacacaaaaaataacattttattatgtagaaaaaaatgagggaatgcttcgtagttcacaaataatgattaaatttgccgcgatttgtaatgttgagtttgcaaaatgacgaataatactataaagcatctaggtattgtggaaaacatacagggttctcatctgtcggtgagaatcgttcagacgtcggcttgtgcggcttgtagcgcaaaaggccactgttcttcggcggatagtaaagacaaagtcatagatataacggatgttacagctgcttcctatcaggtaggagagcgggtgatggtgatcggcgaaacgtcgatgggcatgatggctgtaacccttgcattcataattccttttgtacttctgattgtttccctgttcgcatggatggcattgatagggaatgaactgtatgcggctcttctttctctggcagttcttattccttattatttcgtattgtggctcaataaaacgcgaatgaaacaacatttttcatttactataaaaccaataaataactaaaacattatgaatttgattctgattgcagtgatttcattgggagctatagcgctcgtgctggccgctattctttatgtagcttccaagaaatttgccgtgtatgaagacccgcggattgcccaggtgggggaagtgttgccccaggcaaactgtggtggatgtggctatcctggttgtagcggatttgccgatgcttgcgtcaaagccggttcgctggatggtaaattctgccctgtaggcggtcagcctgtcatggcacaaattgctgatattctcggactggcagctactgaagctgaaccgatggtagcagtagtaagatgtaacggaagctgtgccaaccgtccgcgtattaatcaatacgacggtgcgaagagttgcgctattgccgcttcattgtatggtggagaaacaggttgtagctacggatgcctcggatgtggcgactgtgtggctgcctgccagttcgatgctatccacatgaatcctgaaacgggacttccggaagtggatgaagccaaatgtacagcttgtggcgcttgtgtgaaggcttgtccgaaggcgatcatcgagattcgtccgcaaggcaagaaatcacgccgtgtgtacatctcttgtgtgaacaaagacaagggagccgtagcacgtaaggcttgtacagtgagctgtatcggctgtggtaagtgtgtcaagacttgtccgttcgaagctattacgctggagaacaacttggcttacatcgatccgaacaagtgtaaatcatgtcgtaagtgcgtggaagtttgtccgcagaacacaattatcgagctgaacttccctccacgtaaaccgaaggcggaagaagcaccgaaaacagttgctgcagaagctccgaaggtaacagaataataacagaataaaatacagaattgtatgttaaagacattttcaattggtggagttcatccacacgaaaataaattgtcggcacatcaacctatcatcacagcggaagttcctgcaaaggcagttattctgttggggcagcacattggcgcacctgccaaaccgatagtagcaaaaggtgatatggtgaaggtaggcacgaagattgccgaacctgccggcttcgtttcggcagcaattcactcttctgtcagtggaaaagtggcgaagattgatacagtagtcgatgcgagcggttatgcaaaacctgctatctttattgatgtagaaggcgacgaatgggaagaaaccattgaccgtagcaagacactggtcaaagaatgtgagctttcgtccgaagaaatcgtgaagaagattgccgatgccggtatcgtaggtttgggtggtgcttgtttccctacacaggtgaaactttgtccgcctccttcgttcaaggcagaatgtgtgattatcaatgcggtggaatgtgaaccgtatctgactgccgaccatcagctgatgctggaacacgcggaagaagtcatggtaggtgtctccattctgatgaaagccgtgaaggtaaataaggcatttatcggaattgagaataacaagccggatgctattgaactgatgacgaaagttgcttccagttatgcaggcatcgaagttgttcctttgaaagtgaaatatcctcagggtggtgagaaacagttgattgatgcgattaccaaacgccaggtggcaagtggtgcgctgcctatctctactggggcagttgtgcagaatgtgggtacggcatttgctgtttatgaagctgttcagaaaaataaaccgttgtttgagcgtgtgattaccgtaactggcaagtctgtggccaaaccttccaacttcctggcgcgtatcggtacaccgatgaaacagctgattgatgcttgtggcggtctgccggaggatacgggaaaagtgatcggtggcggtccgatgatgggtaaggctctggtgaatatcgaagttcctaccgcaaaaggcagttccggtatcctgattatgaatcagaaggaagccaaacgtggtgaagcacaaacctgtatccgttgcgcaaagtgtgtgagcgcttgtccgatgggactggagccgtacttgctcggagctttgtccgaaaacggagattttgaaacaatggaaaaagaaagaatcatggattgtatcgagtgcggttcctgtcagttcacttgtcctgccaaccgtccgctgcttgattactgccgcttgggtaagggtaaagtaggagctatgattcgtgcacgtcaagctaaaaaataacgaagtatggaaaataaattaatcgtatcactatcaccccacgtgcatggcggagacagcgtacagaaaaatatgtatggcgtgctgatcgcactgattccggcttttctggtgtcgctttatttcttcggcctgggggctctgattgtcacggctacttcggtagcagcctgtttattcttcgaatgggcgatcgttaaattcttaatgaagaaacctgctacaaccatttgtgacggttctgctgtcattacaggtgtgttgctggcattcaatctaccttccaatctgcctatctggattatcattctgggtgcactgttcgcaattggtgtaggcaagatgtctttcggtggtctgggctgcaacccattcaacccggcattggcgggacgtgtattcctgttgctttctttcccggtgcagatgacaacatggccggtagtaggtcagctgacatcttatatggacgctaccaccggtgctactccgctggcattgatgaaacaggctgttcacggcgatgcaagtgctttgagccagatacctgatgcgctgactctgtttatcggacagaacggcggatgtatcggtgaagtaagtgcgctggcactgttgctcggactggtatacatgctctggaaaaagatcatcacctggcatattccggtttctatcattgtgactgtatttgtatttgcaggcattatgcatatggtggatcccgaaaagtatgtttctccggtattgcaactactctccggaggtctgatgctgggagctgtctttatggcaaccgactatgtgacttctccgatgagcaagaaaggtatgctgatttacggtgtttgtatcggtctgctgacggtggttatccgtctgttcggtgcatatcccgaaggtatgtcattcgccatcctgattatgaatgcgttcactccgctgattaacacctattgtaaacctaaacgctttggggaggtagcgaagaagaaatgaaaaagttacaatcatctttaaagaatatgttgctggtacttacgggcgttacagctgtttccgtagcgttgctggcttatgtgaacgaactgacgaaaggccctattgccgaagcgaatgcaaagacgctgaacgaggccttgaaaaaggtgcttcctgaatataccaataatccggtagccgaaagcgatactgttttcagcgagaaagacggaaagaaaatcgtggatttcattatctatccggccaagaatggcgaaaagtgggtaggttctgccgttgaagccaagtcaatgggatttggcggtgaactgaaagtgctggtgggctttgatgctgaaggcaagatttataactactctttattggcgcacgctgaaactccgggattgggttcgaaagcggacaaatggtttggagcttatgatcctgcaaagaacgaaaaaccggtatctcacgaagaaagtgcaaagtctattttgggcatgaatccgggagagactccattggctgtgaccaaagacatgaatggacaggtagatgctatcacggcttctactatcacttcacgtgctttcctgaatgcggtgaatgctgcttatcaggcatataaaggcggtgaggtggatacgaattccggagcttcccagaaaaatgaaccggctgctgcaccggaaggtgaagcagctgctaatgacactaataactaagaaaggaggagacagttatgaataattttaaagtaatgatgaacgggattatcaaagagaatcctatttttgtgctcctgctcggtatgtgtcctacactgggtacgacatcatcggcaatcaacggtatgggtatgggactggccactatgttcgtcctgatttgctcgaacgtggtaatttcatctatcaagaatctgattccggatatggtacgcatcccttcatttatcgtggtgatcgcgtcattcgtgacactgttgcagatgataatgcaagcatacgtgcccgatctgtatgctactctcgggcttttcattccgctgatcgtagtaaactgtatcgtattgggacgtgcggaagctttcgcagcgaagaacaatccgctggcctctatgtttgatggtatcggtatgggatttggctttaccattgccctgactctgttgggtgccgtacgtgaattcctcggaacaggtaagatatttaatctgaccattctgccggaagaatacggaatgttgatctttgttctggctccgggtgcctttatcgctttaggttatctgattgccattattaatagtctgaagaaagcctaactctattaaataagaaaagaatatggaatatatattgatatttatctcggcaatctttgtaaacaacattgtgttgtcgcagttcctgggaatctgtccgttcctgggtgtttccaagaaggtggaaacagcgatgggtatgagtgcggcagttgctttcgtgctgactatcgctaccatcgtcacattcctgattcagaagtttgtgttggatgctttcggattggggtacttacagacaatcacttttattctggttattgccggactggtgcagatggtagaaattattctgaagaaagtttctccttctttgtatcaggcactgggtgtgttcctgccgttgattacaacgaactgctgtattctcggtgtggcaatcctggtaatccagaaagactttgatctgctgacaggtgttgtatacgcattctctactgctcttggctttggtctggcactggtattgtttgccggattgcgtgagcagatgaccctggtgaagattccgaaaggaatgcaggggactccgattgctttgattaccgcaggtttgctggcaatggcattcatgggcttctctggcgtcgtgtaaaagactaagttgataattagataaagaggctggaaactctgtcgtatggcaacatacaggcagtttgtttccggcctttttctttatatctgttcataccgaatatgttttttatcataccaaaacgccctcaaatcgtcccgtaagtatcttcctgtgaataaaattgcgatagtttattgcatttccattttatttccatacatttgtacctcaaacaaactgaaaaccgaaaaactaaccatattttaaaattatatgaaagaaagaattttagtaacgggaggaacaggctatattgggtctcataccgttgtagaactacaaaacagtggatacgaagtaatcattatcgataatttatcaaattcgagtgctgacgttgttgacaatatagagaaagtatccggtatccgcccagcttttgagaaactggattgtcttgattttgctggccttgatgccgtatttgccaaatataaaggaattaaagcgattattcatttcgcagcaagcaaagcagtaggagagtcggtagagaagccgttgctttattatcgtaacaacctggtttctttaatcaaccttctggagttaatgcctaaacatggagtagaaggcatagtgttctcttcttcctgtacagtatatggtcaaccggatgagttgcctgtaacggaaaaggctccgatcaagaaagcggaatctccttatggaaatacaaaacagattaatgaagaaattatccgtgatacaatagcttccggtgccccgatcaatgctattttgttacgttatttcaatccgattggcgcacatcctacagcattgctgggtgaacttccgaacggtgttcctcaaaacctgattccttatctgactcagacagcgatgggtatccgtgaaaaactaagtgtattcggtgacgattatgatactcctgacggttcttgtatccgtgactttatcaacgttgttgacttggcaaaagcacacgtgattgcaatccgccgtattttggagcaaaaacagaaagaaaaagtagaagtattcaatatcggtacaggacgcggcgtttcagtattggaactgattaatggctttgaaaaagctaccggcgttaaattgaattatcagattgtaggccgtcgcgcaggtgatattgaaaaggtatgggctaatcccgattatgcaaaccaggaactgggttggaaagcggtagaaacattagaagatactttacgctctgcatggaattggcagctgaaactccgtgaaagaggcattcagtaaaaagatatttgttttaattaacataaaagtttaaacaaatcgttcatgcgatttgtttattagatgctaatcagcttgatctgtttgtgagtatgtgaatatgagtaaatggtacttatgcctctccggcatagacaggtatgattgcatagtagttttgtcgtgttttattttgtgtttgtgttgtgacggtactacgacgggagtcgtggtaccgttttttgttactcttttatagcctgcctttaaaacagaatacgttagttccccaatcggtttcaggtaaagttccttccggctcgaacaatccgtatacggaagaaccggaaccgctcatagaggcataaacagccccttgcctgtatagctcggctttaatttctccgatcaccggatgctgggggaatacgctgtcttcaaaatcattgattaatatctctttccattcatttaccgggcgtttgatcgcttctttgatcgagtattcgggatgatgagggtgaatattggcgaaagcttcccgcgttgatacgaatacatccggtttgatgatcagaatctgatatccttttaaggatagtggaatgggggagaatatgttaccgattccttcggcaaaggtcggggcgtttctgataaagaaagcgcagtctgctcccaaagttgcggcatatatttccagctgatcttcggataaattcagctgaaagtgttcgttgagtaatttcagcatgaaagccgcgtctgatgagcctcctcccagtccggcaccggaaggaatgtgtttgtacagatggatctcgataggacagaggtgaaactctttatctaatagcagatatgctttcaccactaaattgtcttccggattaccggatatctccattccgtactgatgcagggagaactttttgtccgcttcggggctggtccggatttccagcgcatcttcgagagcgacggggtagaatacggtttcgaggttgtgatatccgtccggacgcttctcggtaatagagagtcccaggtttatttttgcgtttgggaaagtgatcatattcgttctgaattattatttttgaattttaaattatgggttgcgaatttatgctattggtgacaaagttactaaaatcttcatttttccttatcttttcttcattattatattctatctttgtcatccctttcggcttttactatgtataaaagccggggatcataaattgtaaatcataaaattgtatataagcagatggctgaacaaagaagaaattcccgtaacacaaaatcaactaaagtacaaccggtcaatgattatggtcgtatccaacctcaggcaccggagctggaagaggcggtgttgggtgctttaatgattgagaaggatgcttattcgctggtgagtgagattcttcgcccggagtcattttatgagcatcgtcatcagttgatttatgctgccattactgatcttgccgttaatcagaagccggtggacattctgacggtcaaagagcagttgagcaaaagaggtgagttggaagaggtcggtggaccgttctatattactcagttgagcagtaaggttgcttcttccgcacatatcgaatatcacgcccgtattattgcacaaaaatcgttggcgcgcgaattgataacgtttaccagtaatattcaaagcaaggcttttgatgagacactggatgtggatgacttgatgcaggaggcggaaggtaagttgtttgagatttcccagcagaatatgaagaaagactatacgcagattaatccggtaattgacgaagcgtataagctgattcagaaagcggctgcacgaacagacggtctgagtggtcttgaaagtggatttacgaaactggacaagatgacctccggttggcagaactccgaccttattataatcgctgcccgtcctgccatgggtaagacagctttcgtactttctatggctaaaaatattgctgttgattatcggaatccggtagcgttgttctctcttgaaatgagtaacgtccagttggtcaaccgtcttatcaccaatgtttgtgagattccgagtgagaagatcaaaagtggacaattggcaagctatgagtggcaacagttggactacaaactgaaagatctgctggatgctccgctttatgtggatgatactccgtctttgtctgtgtttgaactccggaccaaagcacgtcgtctggtgcgtgaacatggggtgagaatcattattattgactaccttcagttgatgaatgcgagtggtatggcattcggtagccgtcaggaagaggttagtacgatatcccgttcgttgaaaggattggcgaaggagttgaacattcccattatagccttgtcgcagttgaatcgtggtgtggagagtcgtgaaggtattgacggtaaacgccctcagttgagtgaccttcgtgaatccggagccatcgagcaggatgccgatatggtgtgttttattcaccgtccggaatattataagatttatcaggatgatcgtggtaacgaccttcgcggtatggcggaaattgtgatagccaagcatcgtaatggtgcggtaggtgaagtcttgctccgattcaaaggtgagtttacacgattctctaatccggaagatgatatggttataccgatgccgggtgaacctgcaggtgccatgctggggtctaaactgaatgccggtgctatgcctccgcctccgccggaaccggactttgttccgcagggaaataatccgttcggtgcaacggaaggaccgttacctttctaaaaaaacgtcttttgggttgaatagaatgaccgcttagtcagatgaaaataaccgctcgatttactccaatcgagcggtcgattattttttatagagtatagccaggttgtattctgatagggataggtggcaaaaatgacaaagaatacccctttatttttttgccactttgtcaccaaccatgaatttattggggaataatacagtcaggtccttgttagtttagcttctcttgacatttttctctcaaatcgttctatgtcaaccgaaaaatcttattaactttgcgaaactttttgagaaacaataaaaatttaattatatgaatatctcttataactggctgaaagagtatgtcaactttgatttgacccccgatgaaacggctgctgcgctgacctcaatcggcttggaaacaggtggtgtagaagaagtgcaaaccattaagggtggtttggaaggactcgtaatcggtgaagtgctgacttgcgaagaacatccgaattccgaccatttgcatatcactaccgtcaatctgggagacggcgaacctgtacagattgtatgcggtgctccgaatgtagctgccggacagaaagtagtggttgccactttgggtaccaaactttatgacggtgatgaatgctttactatcaagaagtcaaaaatccgtggtgtagaatctacagggatgatttgtgcagaagacgaaatcggtattggtactgatcatgcaggaatcatcgtgttgccggctgaagctgttccgggtactctcgccaaagactattataatatcaagagtgactacgtactcgaagtagatattactcctaaccgtgcagacgcttgctcacactatggtgtggcccgcgacttgtatgcttacctgattcagaatggcaagcaggctactttgcaacgtccatctgtagatggatttaaggtggaaaatcatgatttggatatcgaagtagtggttgaaaacagcgaagcctgtcctcactatgccggcgttacggtgaaaggcgttactgtgaaggaaagccccgaatggttgcagaataaattgcgcttgatcggtgtacgtcctattaataatgtagtggatattactaattatatcgttcatgctttcggtcagccattgcattgtttcgatgccggaaagataaaaggcaatgaagtaattgtcaagacattgccggaaggcactccattcgtcacattggatgaagtggaacgcaagttgaacgaacgcgatctgatgatctgcaacaaagaagaagcgatgtgtattgccggtgtattcggcggactggattccggttctacggaagctacgacagatgtatttatcgaaagcgcttatttccatcctacatgggtgcgtaagactgcccgtcgtcacggtctgaatacggatgcttctttccgtttcgaacgtggcatcgatccgaacggagtaatctattgtctgaaactggctgctctgatggtgaaagaactggccggtggcactatctcatccgaaattaaggatgtttgcgttgcagctccacaagactttatggtagaactttcttatgagaaagtaaattcgctgattggtaaagtgattcccgtggaaacgatcaagagcattgttaccagcctggaaatgaaaatcatgaatgagacagttgacggactgacattagccgttcctccttatcgtgtagacgtacagcgtgattgcgatgtgatcgaagatattctacgtatctacggatataataatgtagaaatcccgactacgctgaactccagtctgacaaccaagggtgagcatgataaatcaaacaaattacagaatctggttgcagaacagttggttggctgtggcttcaatgaaatactgaataattctctgactcgtgccgcttactacgacggtctggagaactatccatccaaccatctggtgatgctgctgaatccactgagtgccgatctgaactgtatgcgtcagacattgctgttcggtggactggaaagcatcgctcacaatgcaaaccgcaagaatgccgatttgaaattcttcgaattcggtaattgctattacttcgatgcggacaagaagaatccagaaaaagtactggctacctattcggaagactatcacttgggtttgtgggtgactggaaagaaagtagccaactcatgggcacacccggatgaaaacagttcggtatacgaattgaaggcttatgtagagaatatattgaagcgcctgggactggatttgcacaacctggtagttggcaatctgactgacgatattttcgctaccgcactttctgttcataccaagggggggaagcgtcttgcctctttcggtgttgtgacgaagaaactgctgaaagcattcgatatagataatgaggtgtattatgccgacttgaactggaaagaactgatgaaggctatccgttcagtgaagatcagctacaaggaaatttccaaattccctgctgtgaagcgtgacttggcattgttgctcgacaagaacgtacagtttgccgaaatcgaaaaaatcgcttacgatacagaaaagaaactgctgaaagaagtggaactcttcgatgtatacgaaggtaagaacatcgaagcaggtaagaaatcgtatgcggtcagcttcctgcttcaggatgaaactcagacgctgaacgataagatgatcgataagatcatgtctaaactggtgaagaatctggaagataagctgaatgcaaaattgagataaatttaaaattcacaattcaaaattaatacaaaccaatgggaagagcatttgaatatagaaaagccgcaaagctgaaaagatggggccacatggctaaaacatttacaagactgggtaaacagatcgctattgccgtgaaggcgggtggtccggaaccggaaaataacccgacactgcgttcggtcatcgctacttgtaagcgtgagaatatgccgaaggacaatatcgaacgtgcgattaagaatgcaatgggtaaggatcagagcgactacaagagcatgacttacgaaggatacggtcctcacggaattgctgtctttgtagatacgctgactgataatacgactcgtacggtagccgatgtacgctctgtattcaataaatttggtggtaacctcggaacaatgggatcattggctttcctcttcgaccataaatgtatgttcactttcaagataaaggacggcatggatatggaagaactgatccttgatctgattgattacgacgtagaagatgagtacgaacaggatgacgaagaaggaacaatcactatctacggtgatcctaagagctatgccgctattcagaaacatcttgaagagtgtggcttcgaggatgtcggcggtgattttacttatatcccgaacgatctgaaagaggtaactccggaacaacgcgaaactttggataagatgatagaacgtcttgaagaatttgatgacgtgcagactgtttatacaaacatgaagccggaagaaggcggaaacgaggagtaagcggattatggaatatgtttatagaacccagggtacttgcagcacaaacatcgaactgaatgtagaagatggagttgtgaaggaagttgccttttggggaggatgtaacggaaatcttcagggactttcacgtctggtaaagggaatgaaggtagaagaggttatcaagaaacttgaaggagtacgttgcagtggcagaccgacgtcctgtcccgatcagttgtgccatgcactgcatgaaatgggatattaacggaagtctccctttataaaatatacactggcctccggcaattcattttgccggaggttttttattgtgccgtacctttccctatttgtcggtattttgaaccaaaatcgaccttcggtcgttatttataagtatatttgtgctgaataaactattatgcaatgatgaagaatatttttcaagacttgaaacggaaagatcataaacgttatttgggcggactggatgtttttaaatatattggtcccggacttttggtaactgtcggatttattgatccgggcaactgggcatcaaattttgccgcaggttccgagttcggctattcacttctttgggtggtcaccttatccactatcatgttgattgtcctccagcataatgttgctcacttggggattgttacggggctttgcctttcggaagccgctacgaaatatactcctaaatgggtatcccgtcctattttgggtacggcggtattggcgtctatttctacttcattggctgagattctgggaggagccatcgcattggagatgctgtttgatatgcctattatgtggggggcggtgctgaccacactttttgtctccatcatgctctttaccaactcctataaaaagatagaacgttccattattgcttttgtctcggtgatcggtctttcatttatttatgaattgtttctggtagaaatagactggccggctgcgacgatgggttgggtgacgcctgctttcccgaagggtagtatgctgattattatgagtgtgctgggagcggttgtgatgcctcataatctgtttctgcattcggaagtaatacagagtcacgagtataataagaaagacgatgcgtctatcaagaaagtattgaaatacgagttgttcgatacgcttttctcgatgatcgttggctgggcaattaacagtgctatgattctgctggctgctgctactttctttaaaagtggtattcaggtggaagaattgcaacaagccaaatcactgcttgaacctttgttgggaagtaatgcggcaatcgtattcgcattggctctgttgatggcaggtatttcgtccaccataacaagcggaatggcggcaggttctatctttgcaggtatctttggagagtcatatcatattaaagacagtcactcgcaggtaggagtaatcctttcgttgggaattgcgctgttgctgattttctttattggtgatccattcaagggattactgatttcgcagatgatattgagtattcagttgcctttcacggtattcctgcaagtagggttgacttcatcccgaaaggtaatggggaattatgtcaatagccgttggagtacttttgtattatatgctattgcagtcattgtttcggtattgaatataatgctgctgttttcataaaacgaacataaatctataaactataaaatgatgaagattattacttataatgtgaacgggcttcgtgctgccgtttctaaaggtttgccggaatggctggtgcaggagaatccggatattctttgtctgcaagagacaaaactacagccggaccaatatccggcagaagtatttgaagctttgggttacagggcttatctctattctgcacaaaagaagggatacagcggtgtggcgatccttactaagcaggaacccgatcatgtggaatatggtatggggatagaagcttatgacaatgaagggcgttttatccgtgcggattttggcgacttgtccgtagtcagtgtttatcatccttcgggaacgagcggagacgaacggcaggcatttaaaatggtgtggctggaagactttcagaaatatgtgacagagctgcgcaagactcgtccgaaccttatcctttgcggtgactataatatctgtcatgagccgattgatattcatgatcctgtccggaatgccacgaacagcggcttcctgcccgaagaacgggaatggatgactcgtttcctttctgcaggatttattgattctttccgtctgctctatccggagaaacaggagtatacgtggtggagctatcgttttaattcgcgtgccaagaataaaggctggcggattgactattgcatgaccagtgagccggtacgtccgatgctgaaaagtgccagcatactgaacgatgccgtacattcagatcattgtccaatggctttggaaatagaataaaaacagaaaatagcatggaagatagaatacaaaaagctgtagaactttttaagagcggatataactgctcgcagtctgtagtagctgcatttgccgatatgtatggtttcacacaggagcaggcagtgcgtatgtcagcctcttttggcggaggaatcgggcggatgcgtgagacatgcggggctgcttgcggactgttcctgatagccggactggaaaccggagctaccgaagcgacagatcgtgaaggaaaagctgcaaactatgcggtagtgcaggaattggctgccgaatttaaaaaacgcaacgggtcgttgatttgcggagaattgttgggattaaagaaaaaagagccgatttcgactgttcccgaagaacgtaatactcaatattatagcaaacgaccgtgtgctaaaatggtggaagaggcggcaagaatttgggtagaatacctcgaaaaacaccctaaataaggggataaaatgcttttttattacaaaatcagcaaaaaaagattcaataaagtgttatataacataaaaataactatctttgtccccgaaataaaatctgaaagctttcgggccggatgatttttaaagcatgtctaactataatttcaaaagcaaatgttgaaagaaaaagcaggtgtaatcgcaggtaatatctggaatgcactgaatgaaacagaaggaatgactgccaagcaactgaaaaaagcaactaaattggttgacaaagatttgttcctcggccttggctggttattgagagaagataaagtttctgctgaagaagtagaaggtgaactcttcatcaaattgatctaagcgagtaactcacttaagcaataaaaaaatgcgttggtacatgattataatgttatcaacgcatttttttatattccgccatttacgtatctttgcacaccaaaaagacaaaataataagaattcagaatgaagaatatacgaaatttctgcatcattgcccacattgaccacggtaaatcaaccctggcagaccgcttgctggagtttaccaacactattcaggtgactaacgggcagatgcttgatgatatggatttggagaaggagagaggtatcaccatcaagagccacgctatccagatggagtacaactacaaaggtgaaaagtatatccttaacctgattgacactccggggcacgtggatttttcgtatgaggtatcccgttccattgccgcttgcgaaggtgcgctgcttatcgtagacgcatcgcagggagtgcaggcacagaccatctccaatctgtatatggctatcgaacatgatctcgaaattatccccattatcaataaatgtgatatggcaagtgccatgcccgaagaggtagaggacgaaatcgtagaactgttgggctgcaagcgtgatgagattatccgtgcatccggtaagaccggaatgggcgtggaggaaatcctcgcagccgttatcgaacgcattccgcatcccgaaggtgatgaggaagctccgttgcaggcattgatttttgactctgtattcaactccttccgtggtattatcgcttactttaagatcgaaaatggagtaatccgcaagggagataaagtgaagttctttaataccggaaaagagtatgatgccgatgaagtaggtgtactgaaaatggaactggttccacgtaacgaacttcgtacgggcgatgtaggttacattatatcgggtatcaagacctcgaaagaggtgaaagtgggagataccattactcatgttgcccgtccgtgtgataaagcgattgcgggttttgaagaagtgaagccaatggtttttgccggagtctatccgattgaggcggaagattttgaggatctgcgtgcttctttggaaaaattgcagttgaatgacgcttcgctgactttccagccggaatcttcattggcactgggcttcggtttccgttgcggtttcctcggattgcttcacatggagattgtacaggaacgtctggatcgtgaattcgacatgaatgtgattactaccgtgcctaacgtatcttataatatatatgataaacaaggcaatatgaaagaagtgcataaccccggtggtatgcctgatccgacgttgatcgaccatattgaagaaccttatatcaaagcgtctattattacgactaccgattatatcggcccgattatgaccctctgtctggggaaacgtggagaactcttgaaacaagagtatatttccggtaatcgtgtggaaatatattataacatgcctttgggtgaaatcgtgatcgacttctatgaccgattgaagagtatttcgaaaggatatgcgtcgttcgactatcatcccaatggtttccgtccttccaagttggtgaaactggacatcatgttgaatggtgaaccggtcgatgcgctttctacgctgattcacttcgataacgcgtatgatatgggacgccggatgtgtgagaaactgaaagaattaatccctcgccagcagtttgaaatcgctattcaggcagctatcggggctaagattatagctcgtgaaactattaaggcagttcgcaaggatgtaactgcgaagtgttatggtggtgacgtaagccgtaaacgtaaactgcttgaaaagcagaaaaagggtaaaaaacgaatgaaacaaatcggtaatgtggaagtgccgcagaaagccttcctcgccgtactgaagctggattaaaaaatgaaccgcaagcgatttttcagagagttattctgaacaaatcggcttgcggttagttttttaatacaccaggtgattgtcttctgtctgcagagctttccttggcaatcaccttttttgaaacaaacaactataaatatgagaaaagttctgtctttttcgggcttcctgatgttggggctcgtcatttcacaattcctcccgatgatagcgggagaaggatatggaactgttaaggtcctgtcgaatatactactttatgtatgtcttagttttataatgattaatgtgggtcgggagtttgtgctcgacaaagtccgctggaaaagttatgccgaggattatcttatagcgatggctacagctgccctgccttggttcatgattgctatctattatgtattcgtgcttcttccgcctgattactggaatagttgggaggcttggaaagagaatctgttactaagtcgttttgccgcacctacgtcggccggcatcttgtttacgatgctggcggctatcgggttaaagtccagctggatatataagaagattcaggtcctggctatttttgatgatctggataccattcttttgatgatccctcttcagatcatgatgattggtttgcgttggcagctgattattgtggtggttattgtatttatgctgttgtccattggatggaaacaactgaataagtataactggcggcaggattggaaagctattctcttctattccgttatcatatttctggctacgcagatactttatctcggcagtaaagagctgtatggagaagaaggaagtatccatatcgaagttctgttgccggcatttgtattgggtatgatcatgaagcataaagagcacgatactcctgtagaacgaaaagtctctactggaatctccttcctgtttatgttcctggtaggtatgagtatgcctcattttatcggagttaactttgcggaaactcatacaggaacgcattcggtgacaggttcgcaggagatgatgtcctggggaatgattttgttccatgttgtcatagtctctttcttatcgaatataggcaaactttgtccgatgttcttctatcgtgaccggaagttgagtgagcgactggccctttccattggtatgtttacccgcggtgaggtaggtgccggaattatatttattgcattgggttataatctcggcggtccggcactggtcatttccgtacttacattggtgttgaatcttattctgacaggaatatttgtcctttgggtgaaaaacttggctttaaggagctataatgattaaaaaaatccatatattgcggatcaaatactataaacacctttcattatgacaattttgcgtacaatgcgaaatttctcgtcaatgaatattgcggcgagtatccttttgtttgtagcggcaatagcggctgctatcatagccaattctccggttgctccggtttatcaggagttccttttgcatgaacttcatttgcagatcggtaattttaatctgctttcgcatggcggagagaatctgcggatgatcgagttcatcaatgacgggttgatgaccatctttttcttgctggtaggattggaaatcaaacgggagttgttggttggtgagctttcttccttccgcaaggcggcgcttccctttattgctgcctgtggcggtatgctgtttccggtgattgtttacatgtcaatctgtcctccgggcagtgcgggaagtcagggattggccattccaatggcaacggatattgctttttcgttaggggtattaagtctgttgggaagccgtgtgccgttgagcctgaagatatttctgacggcttttgcggtagttgatgatatcggaggtatccttgtaattgctcttttttatagttcgcatgtgtcgtatgggtatattctgatagccgcattgctttacgttttactttattttatagggaagcgtgggactaccaataagattttctttttagtgatcggtgtcgttatatggtatttatttttgcaatccggtattcatagtaccatttcgggagttattctggcgtttgttattccggcgaaaccccgtctatatgttggaaaatatatcgagcatattcgtcatacaattgcaggtttcccggtggtggaatcgggaagtatcgtattgactaatgagcagattgccaaactgaaagaggtcgaatctgcttccgaccgtgttatcagtcctctgcagtctttggaggataatttgcatggagctgtcaattatctgattcttccgttgtttgcctttgtcaatgcaggcgttgtctttagtggcggcggtgagttggtgggaagtgtagggatggcagtggcagcagggttgctgtttggtaaatttgcgggaatttatttctttacctggttggctataaagataaaacttactccaatgccgccgggcatgacttggaagaatctttccggtatagctctgttgggagggatcggttttacggtgtcgcttttcattgccaatctttcttttggtgcaaactaccctgttctgttgaatcaggctaagttcggagtgctatcggggactattctttccggattattaggatacattgtactcaggatagtattacctgtccgaaagcggaaataataactagagatcagtcgttcaggcatatcggatattcatcaggcgatatgccttttttattgtatatataatataaggtgaaaatgatatctactaataatattagttaaacaactgctttatttagtagattaactaatagtattagttgtttgtttgaaaaatagtattatatttgtgccattggaagaacaataaatatgtagactatgaaacagatgaaacgattgaccgtcaaagaggaagaaattatgcgtatattttgggaacatggacctatgtttgttcgtgaacttctatcattctatgatgaaccaaaaccgcattataacacagtttctacccttgttcgagggctggaggagaaaggttttgtggggtataaagcctacggaaatacttatcaatattatgctcttgtttcggaaaaggagtataagagttcggcactcaaagaagtggtttcccagtattataataattcctatatcaatgtagtgtcttcttttattgaagaagaagggatgtctgttgatgaactaaaatcgctgatagagtatatagagcaaagtaaaaagaagaagtaatctctctctggtctatcggacagatacgatttttattctatggacaaacaacttttaatctgaaaacacaatgggagcttttttattctatctgctgaaatccggatgttgcttagtggtcttttatattttctttaagctgctgatgagccggagtacttttttccgttttaaccgcatcactttgttggttgggttgttaggatgtactttgcttccacttattgagctgacaactaccgaggagacttttttgcatactccgttgtatgccattcacgagatattgcaaagtacggagtctgtcattctaaatccggaacagatggaagatcctattcttatatctgaaaagaatccggaaataaactctttgaattggattcctgtgactttagcttttatatatggagtgggggctttggtgacactgatctggttgtctttgtccacttgtcgtttgattcagttgattcgtacgtcagagaaaaaacagtttggaaactatgtattagtgattcctcagcagccaactgcttcatttagctggggtaaatatattgttatttcagcagctgactactctcaacagtccgaagaaatactcctccacgaaacgatgcatttacgaaatcatcatactttggacttattgtttatgcagatattcctgcttgtttattggtttaatcctgtcgtttggctactaaaacgggagttgcaggaagtacatgaatttgaagccgataatggcgtaattaatacaggcatcgatgcaactaaatatcaattattactggtgaaaaaagctgttggtacaaggctctactctatggctaatggctttaatcactctaaacttaaaaaacgtatcactatgatgttaaaagaaagaaccaatcgttgggcacgattaaagctgttgcttgccgtgcctgtgatggctggagcgctttatgtgtttgcacagccggaagtgaaagaagttccgcgacagattcagtctgaacttcagcagaaagaagcggatgattattcatctttgatgttttttttcaaagaagggggagagagatacagcaagctggttaatggagcgtatccaccctctaagattaaagcaagacaggttcactccctttttgttaataaacaaaatagggtgatgttcgataatgatgtatgttcagtggatgagttgaagtctactattgtgaagaatttgatgaaatcctgggaagaaagtaagaggaaagaataccaagttatttcttttcaggttgatcgcggaagtgaaattgctgcactcactactatactcaaagaagtaaaaggagcatttgagcaaattcgtgctgatttgtctattacattgacagataaaagtgaagaagcgttggaccgattgtttcccgttctactgtcggaaggtgctgcgagaaattatggattgaaagagctgtcaatggaggagaaaatcagtgggattgtggtaacaattcacacttcggaagggaaggaagtaatgaaagattttactttaacggaattgaaacagaaagtcactgctgcacgtgcaaagcaagctgatccggaaagtttggttattggcctcaagatagagaaagggtgtaagatgggatacgtgacggataccaagcaggtgctgagggaatgtagtgcattgaagattaattattcaactgataactaattagtttataaatagtgtcactatatagccagcatagtgacactatccaatcagcatagtgacactatcccaaccggatagcgacaccatcttaaaaggtctataatttttgttttattcatcatccccgtcatccgctatcggcagaattctctgactttcctcatggggcaattgttctacttggcgtagtttccgttcaatagcgcgggttctttttcccatcacttcttccagttggtcaccggcactttgcaggttcttctgtaccttttcgagtaggcctccgaatttgctgaattcagttttaactgctcccaaaactgtccacacttctccggtacgcttttgaatagccagcgtgcggaaccccatctgaagactgttcaatatagcaccaagggtagttggtcccgtcactacaattttatattctttttgtagcgtctctaccaagcttgttcttcggatcacctctgcatagatgctttcaaaaggcaggaacatgatggcaaagtctgtggtgaaaggcgggtctacatatttatcgtgaatatctttcgccattttcttgatggttgtttccagctgcttgccggatgattccatcaatgcagtatctcctgcctcgaaagcgtcgtagtattgctcatatacatctttcgggaattttgcatcgataggcaggtatacagtgctgttcgcatcatccttacccggtaacttaatggcaaattccacaaattcagttccgcttttcttggttttcacattggcgtcatattgttccggactcatcatctgttccagcaatgctcctaactgaacttcaccgaatgtaccgcgcatttttacgttactcaatacttttttcagtccaccgacgtcttgtgcgagagatttcatttctcccagtcccttctgtacattttccagttgtgagcggacgatttcaaaggactgtccaatgcgttcattcaatgtcttctgcaatttttcttccaccatcagtcgcatatcatccagccgcttttcagtcgattttatcaagacctcttgctggcgtgccattgtgtcgaacttttggcgttgcagttccccgtttgtcatcatgttcttatgcagtacgtcttgcaattgttgcatattctgattcagcgtttgggtcatttccatgcgaagttcccggatactgcggtttagttcttcgcggttctcttgcatttgctggcgcaaggctgcctgtaattgttccgcttgcgcatgattatttccttttgccagtgatagtacaatcgagattactgctaatgcggcaataacaataagtagaatcagttccatcaataagtcagaatttcgtttccggtttcagtaatcagaatcatattctcccattgggcagaaggcagtccgtcatccgtgcataccgtccatccgtcagcttcgtcaacaaatacttcataagtacccatatttatcatcggttcaatggtgaaggtcatgcccggaacgatcatcattcctgttccccggcgtccgaaatgttccacatccggtgcttcatgaaactgcattcctacaccatgcccgcaaagatcgcgtaccacgttgaatccgttcttttctgcgtgttcctgaatagcggcgcctacatctcctaattgtttccaaggctgtgcggcggctatacctatttccatacactctttagtcacttgaaccagtttgcgcatttcgggacttacgtcaccgatcataaacatacgggatgcgtcggagaaatatcctttgtaaatggtagaaacatctacattgatgatatctccgctttgcagtatttctgttttgctgggaataccgtggcataccacatcattgatactggtgcagacgcttttaggaaatccttcgtagttgagaggagcagggatggcaccgtgctttgtggtgaagtcatataccatgacatcgatttcttcagtcgacattccttcacggatattctccgaaatataatccaacagggcagtattgattttggcactctcacggattccttccagttgttcgggagtacgcagtactttgcgcggtgggagtttgtaaccttgttttctgtatttctgtattttcgcttctacttcagccggataattggagggagtaaaccggaatcccttgataaagttcttcattattataggatgttttttaatcgtactacaaaggtacgagaataaatggaaaatgaaatcgtttatcatgtgattccttttttaccattcataagaaatacagatctgaggcacccattcccatcttttttgtatggtgttgtattgatattgtacgccggttttcaatttccagcctttacctacttttaaaacaatgtcgctgcctagtgtggttggtattgcttcagaggaaagtccacgatatcttcgggtgtccagattttgtttaccatatatgctaagaaaccattttttagagagcttataatccatttgagtttggatatgaaagtggtttgaactttcactaaagttacttttactatgcagagtgatatttttgtttattttgagccgtgaataagtgggtaagaaagtagaattggtctgtcgaaagatgttatgagtatgaaaaggtaatttcggagatatgattgttgatttaagaatcggtaatgttggatcaaagtcaacaaagggttttgtatgatataacatgttttgttctgtcttctttacgaataccttattgattctgatttcttgctcagaatttaatgtttgctgtagcctcaatgaatcttgtttgctccactcttgtcctgctacggataaggggagtaataatagacaaagagtacctaactgatatttataagcgtccatatagtgtgctagtatagtttattctatggacggtgaaaaagtgaaaatgctgctttatgtaatgaataaataatagctattttacataatatgagaatacttttctttttttgtataggtgtattaagcacatttatcgtgtccagtcgcacctatggaaacaaaacctatatagctgtttttttatgtattgagtgataagttctagtttcttgattggttcatctttcataaatcttgaatgatattgagagaaaaaatgaggtggaaaaatatagatgttataattacaaccactttttttctgagcattgcaggactcatagttcttattatcattctttaatgttttgtatttaagataatctttttgctttaaataccggttctatcttctgaatctccgattcaaatccgaaccaatagccatgtcctgcttcgtcaataggaagaaaacataaccggaggttctcacgatatgaaccatatataatttcccaattatcgggaggaacttggcgttttgtctttactttttcagcggggattttttttaacgacataccggcttctatccatgcaatactgacttgtgtcacgtaatcgggataatgattcttgcagaaattatagaggataagtccccttttttccagactcaaaggagtgtcgatgacatctgtctgtattagatggtcaagtaactcgtgcaggaaatgcggattatccaaaatgagggtacgagtcagacttcgccatgtaggtgtattatagaatccgtctaaaagacgggacagatagtgggcggtttgcaattcttctacggaaatttttttagtctgcaaaacttcgtagggagggagaggagagtattggatgcctaactcttccgcccttcttcgcatttccgtgccgggaagtaattttaatgattccagttgtatttcccctgcaccatattcggcaagtgtacgaacgtcttcaaatatttcggataggtgatagagaggaagaccggctattaagtcagcatgtgtctccatgttcttaagggaacaaagatatttcagaccttgaagggcatcagataattttccgatacgtcggcttttctctaatacgggttcacgaaggctttgaatacctgcttcgaggtgtagcaaaccattaggtaaaatagcgagttcttcttttaattcttcggagagaagtgccgggtgaatttccaaatggaaacagatgtccggggcatattcacggaagaggtgaagaagttctttggctcgcttattattatagttgaaagtgcggtcgagtacacgcacatttttgatgccatgctgatggataacattcagtcgttcgcggattgcctccaatgaaatggtgcgaaccggtttctcacctccgctgacgcagaaagcgcatgtgttgaagcatcctcgggtagtttccagttgtacgaaaggcttgctccaattaaaaaaacgacttttctccggtgagacgagctgagagaagttcatgacacgggcaataccgttgtcttgatattggtctgattcgtccagataacataatccggatatctgattccactcatttacagggtgattccatacttttaaccaaattgggaatacttcttctccttctccccgaaacactccgttgacaaatttgttctttcttaagaaggcttcgttatttcctaaaaactccggaccgccgagtacgatgcagcaatgaggtagcaaagctttagcacgtgaaacgatatgcaacagttgctcgtgattaaatagccagttggtagcagcaataatatccggttgatggtgatagatttggttgactaccattccggtattttcgttgatggttgccgatactgtacaccactcaatggtagtgtcatctgctatttgagcatgtaatgcaggcaatgccagcgatgagtgcgcataggagctatttaaatcaagccaaagaagtttcatgtgtaaattttactattagtgggacaaaggtacaaaaaacttgcatcttaaggcatatagtaaaataaaaacgctaattttgcaataataaacgcaataaactagaaaattatgaagaatttgaaaaaatacgtaggtgttctcatgttgctgactttattggtcggctttacttcgtgcgaagatgatgaaactatatttgatcacatagtagggcgtacatgggttggtgatttaggattttgggtagataatagtccggtggaaagtggaataacctttaagagtaatggttttggtgtagatgaacaatggtattatgattgggatagagtagcggctgttttagatgtccgctggtggattgaagatggagatttattcttggattatggtaatggctatcctttattaatattagcagatgtttatgttgaaggccgatatcttacagggcgtttgtattcaaataatatagatcaaggaaccgttactttagaaatgagtaattagtgaagatctaaaaaagaattgtggaattggaaaaaatatcgatttttttataaaagttccccttattgaaggctaatctatgtacagagttgtcagcaaataaggggaatttttattattttatttcttcaggaacaacttcttaaactctcccggataaggtgtctcaaactccattaaatctcccgtcaccggatgatagaaacaaagtttgaaggcgtggagtgccagtcttccgattgggttaagcgattcttcgcctccatatcttccgtcacctataataggatgtcctaaattctgcatatgtacacggatctgattcttacgtcctgtttccagatcaagttctaacagtgaataaccgttagcacgtttgattgtcttgtagtgtgtgatggattttgaaccaccatcatcataatcgctggagcttacataaagagttttatccgtcagccaggaaaccacagtgtcataatccttctccattgttccctcaacaacagctacataacggcggtcagtcactatttcatgccagttgtcacgtaatgtccgttgtgttttttcgtcttttgcgaacatcattaatcctgatgtatccctgtccagacgatgtacgataaacacacggtgctgtctgcccgagcgctgtacatattcattcagaatcgtataagcggtgcgctctttttgtcgctcggtattgacagataagagtccttgcattttttccactacaatgatataagcgtcctcatatacaattttcagcagtctgttatgaaattccttctttcctttttccttgctgatttgtactttcattccgggttgcagcgggaagttgaactgagtggtgattacgttatctaccaataccacccgtttgctcagtaatgacttcagtttcgtgcggcttgcgtccggcattttggcagccagaaactccattagttccatgggctctttgactgcatagttcgtatattgggcacgtgctttttctgcaggagttcttctcggtcttttttccatttcttttttcttttgcgaacaattcaactaacgtattatcgaagctccagcaacactacattttccacatgatgcgtatgcgggaacatatctacaggttgcacagctttcactttatatttgccgtcaagcagttgtaagtcgcgtgcctgcgtagccgggttgcagcttacatacacaatccgcttcggttcggcaaacagaataacatcaaccacatcctgatgcatacctgcacgtggggggtcggtgataatcacatccggacgtccatgctgattgataaattcctgagtcagcatatctttcatatctccggcatagaacaaggcattcttaatctcattaatctcggcatttacctttgcgtcttcgatagcttccggtacatactcgataccaatcacctgacgggcctggcgggatacaaaattggcaatggttcccgttccggtatataggtcgtataccagttcctttccggtcagcccggcaaattcgcgggctatcttatataaattgtatgcctgttcggaattggtctgatagaatgatttcggaccgactttgaaacgcagtccttccatttcttcaaacatatggtcttttcccttgaatacatgtacatccagatcattgatcgtatcgttgcacttattattaataatgtataggagagaagtgatttcggggaatgaatcggcaatgaactgcagcagttgcttgaatagttccatttcatggtcttctgtaatcttgcagatgacaatgaccatcagctctcctgttgatgaagtgcggataatcagattccgtaacataccttcctgagtacgcagattgatgaaggagtaatcatgctcgtaagcataatcgcgtacagcattacgaatacgattggagatgtcgtcctgtaaccagcatttttcaatagccagcactttgtcgaaagctccgggaatatgaaaacctacagcattcatctgatcatacttcacatcctgccgaacttcatcgttcgtgagccagcgtttgttcgaaaaagtgaactccagtttattccggtagaactctgttttggcagaacccagaatcggtgaaatttccggaagttcgatctttccgatgcgtctcagattgtcttctacttgtttctgcttatacctgatttgttccgaataggggagtacctgccatttacaaccgccgcatacgccgtagtgttggcagaaaggaacggcacgtacgggcgacagctcgtggaatttcacagcttcggcttcggcgtatttgttctttttgcgcttgatctgcaggtctacaacatcacctggcactacataaggaacaaaaatcaccaggtcgtttacttttgcgatggcttttccttcggcagccacatccgttattgttaccttctccagcaggggaagttcttttctctttcttgccacttttacaccaatctaataattatgatgcaaaagtaggtattttttttggaaaactttcgtgtctatgaaaatattccagattgtaatgtcgaaattgcattttaatagaaagttttttctcaaaaagttttctggtttgcgaaatatacttagatttgcgaacagaaaaaaatcataatgtaactttaaacacaatattatggataaaaaaagagtttatacctttggaaatggtcaggcagaaggaaaggccgacatgaagaatttgttaggtggtaaaggtgccaatcttgccgagatgaatttaattggaattcccgttcctcccggatttacaataactacagaagtttgcacggagtataatacgttgggacgtgataaagtggttgagttgctgaaagatgaagtagtaaaggccattgcccgtgtagaagaattgatgaaatctaaattcggtgatatcgaaaatccattgttggtttctgtacgttcaggtgcccgtgcgtctatgccgggtatgatggatactattctgaatctgggtctgaatgacgaggtggtggaaggtatcatccgcaagactggtaatgcccgttttgcatgggactcttatcgtcgttttgtacagatgtacggtgacgttgttctgggcatgaagccgacgaacaaggaagatatcgatccgttcgaagcaatcattgaagaagtaaaagaatcaaaaggagtaaagcttgataacgaactggaagtagcagacctgcaagagcttgtgaagaagttcaaggccgctgtgaaagaacagaccggaaaagatttcccgacttgtgcttacgaacaactttggggagctatctgtgccgtatttgattcatggatgaacgaacgtgctatcctttatcgtaagatggaaggtatacctgatgaatggggaacagctgtaaacgtacaggctatggtattcggtaatatgggtgacacttctgcaacaggagtttgcttctctcgtgatgccggtacaggtgaagaccttttcaacggtgaatacctgatcaacgcacaaggtgaagatgtggtagccggtatccgtactccacaacagattacgaaggttggttctcagcgctgggctgtactggcaggtgtgactgaagacattcgtgctgcaaaattcccttcaatggaagaagctatgccggaaatctataaggaactggatgcattgcagactaaattggagaaccactataaagatatgcaagacatggaattcaccgtgcaggaaggtaagttatggttcctgcagactcgtaacggtaaacgtaccggtgcggctatggtgaaaatcgcaatggacttgctccgtcagggcatgattgatgaaaagactgctttgatgcgtgtagaacctaacaaactggatgaacttcttcacccggtattcgataaatctgctttgaaacaggcgaaagtgctgactcgcggtcttccggcttctccgggtgctgcaaccggtcagattgtattcttcgctgatgatgccgccgaatggcatgctgccggaaagaaagtggtaatggtacgtatcgagacttctccggaagacttggccggtatggcagttgccgaaggtatcctgacagctcgtggtggtatgacttctcatgctgctgtggtagctcgtggtatgggtaaatgttgtgtatccggtgcaggagcattgaatatcgactataagactcgtacagtagaaattgacggcattgttttgaaagaaggcgattatatttctttgaacggtagtacaggcgaagtatataatggtaaggtagaaactcaggctgccgaactttccggagactttgccgatttgatgaaactctcggataaatatacccgtctgcaagtacgtaccaatgcggatactcctcacgatgcagaagtagcacgcaactttggtgcagtaggtatcggtctttgccgtacggaacatatgttcttcgaaggtgaaaagatcaaggcgatgcgtgaaatgattctggcagaaaatgcagaaggacgtcgtaaagcactcgctaagattcttccgtatcagcaagccgactttaagggtatctttaaagcaatggtcggttgtccggtgactgttcgtctgctcgatcctcctttgcatgagtttgttcctcatgatacgaagggacagcaggaaatggctgatacgatgggtgtaagcctgcaatatatccagcaacgtgtagaatcgctgtgtgaacacaatccgatgttgggtcaccgcggttgccgtttgggaaatacatatcctgaaataactcagatgcagacacgtgctatcttgggtgctgctcttgaactgaagaaagaaggagtagagacacatcctgaaatcatggttccgttgaccggtattttatatgaattcaaggaacaagagaaggtgattcgtgaagaggctgccaagttgtttgaagaagtgggcgacagcattgatttcaaagtaggtactatgattgaaattcctcgtgcagctctgactgctgaccgtattgcttcatctgctgaattcttctcattcggaacgaatgacttgactcagatgaccttcggatattctcgtgacgatatcgcttccttccttccggtttatctggaaaagaagattctgaaagtagacccgttccaggtgctcgatcagaatggtgtaggtcagttggtacgtatggctacagaaaagggccgtgctatccgtccggatttgaaatgcggtatctgtggcgaacatggtggtgaaccgtcttcagtgaagttctgccatagagtaggtttgaattacgttagttgctctccgttccgggtacctatcgcaagattagcagcggcgcaggctgcaatcgagggataaaggcggtatagctgatattcagttaattaggcggtatgcttttcatttacaaaggcttaccgcctattgtgtttttaaaatgtacgtgcattttgcacaaaaaatgagtagaataaacgcaaatgttgtacaatagttatgcagttttgacaacagtgttgtacaagtgttgtacaaatgctttctccgtatagtcaataagttacggacgttttgccccaatcacattgaaacacggaacagtcgctttggaacacagtacacccaaacagaatgtttaattataaaatgaatataaaatggcaacattgaaagcagtagtgagaacggcacgggctgacggattttatccggtatatatccgggtgactcatcatcgaagctctgcgttcattaaaacagacaagatggtgacgaagaaggaactcaccaaaactaatgagattaaagacccgtatgttttgcaattctgttcgcagagaatattggagtatacggagaggcttaatagcaaaaatatcgagcattggacagtcaaggaagtagtcgagtttcttgcaagtgggaatgatgacgtttgtttttcagattatgcacgaaagcatatcaaccgaatgattgataacggtcaacaacgtaatgctaagaactatcagctggcattgcaacatttggagcgttttttaggaacaacgcagataatgttctcacacctcacatcgcacttgatgaataggtggattaagtcgcttgaacagacacaccgagctaaggagatgtatcctatctgtatgcgacaggtatttaaagctgctattctggagtataacgactatgataatgggattattcgtataaaaactaatccatgggtgaaagtggagattccttcggcagatcgtgcagaaaaactagccattacccccgaagcgtgtcgggagttcttttcatttcctctgccggaaagtaagatgaaatatccacagacggagtttggacgtgatatagccatgatggtgctttgtttggcaggaatcaacacagttgatctatacaatttgaaaaagcaggattatcggaacggcatcattcactatcagcgtgccaagacaaagaagtttcgtgccgacggtgcatatatggaaatgcgcgtgccggcaattattcaaccactcttcgataaatatctcaatacgaaggaggatgacgatcgtctgttcaatttctaccagcgtatgactacatctgacagttttggttctaatgttaatagtggaattaggcaaatatgtgaggccatgggaatggccaaagaagaacggtattcggtctatacattccggcacacgtggggtactgtggcacagaatgacgtgagagcttcaattgatgaggttgcatttgcgatgaatcatgctgctggacataaggtaacacggggctatataaagatagattattcacctgcttgggaattaaacgagaaagtggttgatttcattttcttctccggtaagacatctgttcgcgagcagaagcaggaagatacgcattttagattatcattccgatatatggtaaatggggcggcttaccacaatgggcagaaagttgcagagttgactgatgtaggattcaacaacgtggacgatgttatagcacgacttgtgacaatgttaccccaagatattcctaaccgttctatggtgatgtttaaaatcgtcaatcttgataagaatcagacggtagtatatcagcggcagaaaggaaagggcttctgattttttcgaacctacaaggaactttttctttgtaggttttttttatgaagaaaagcgacatcctttcggatatcgcttttaagcaaaactgtattatacccctaagggtaagcaactcctcgcgtctaaagtagagagaagtagattattcttcgtcgtcctcttcatccccagcaagttcgaccagcttatcctcaatggtctttttcgtctctgttgcgacatcaagtgttgttgtctgcaatttcggtgcaacataagctgtaaacttttccatagctgcaactctatctttggggtcaaggtcggctatatccttcacgaaaatatcagaattgaagtactcgtcgagcatttttgcaattgctccacggactgttgaggacaccttgttaggtgttcctgctactctccctcctgtttttcttccctgtgccatgaactgtaaaaagataaaatgatgttgcgaatataagggcttactttcgcactcgaggtataacttttaataattaaaacagaagtcttatgggattgattggaagtgctataggggcagcaggtagtatctttggtggtatctctgcatcgaaagcaatgaagaaaattcaaagaaacgttgaggcgcagcgacagaagaaccaaaattggtatgatcgcaggtacaatgaggattatacgcaacgagccgatgcgcaacgtattctcacgcagacggaagagagtatcaagaaccgtaataagcaggcagctggtatacaggctgtaatgggcggtactgatgaatcacttgcagccgcaaaagaagcgaatagcaaggctcttgctgatgcaacatcacagattgcagcacatgcggatgagcgcaaagacaacatcgaggccacctatatgcagaatgacaatgcttttgttgagcaacttaatcaattagaaaaaggtaaggcagaagcgatagccggagccgtacaaggagtaacgagtgcggcaagtaaaatgccattttaatgtgtggaggtaacttatggcgacatatgatgatatattaggtaatggaagtggcacaccttttccgaaaggttctaaagaatggcatgaacagcagcaagacggttcttctgcatctccacctgtaaagggtacacaggaatgggcggaacaaaaagcggccaccgctcctgttgttaccgcactcaaacctgacataactactacaccgccacctccgaccaaacaagaaggctcggacggtggtgccctttcatacgccgaactgttcaagaagcttaatccttatactccaccgactgacgaagaacttgctaaagaaaagaaaaagcaaaaacgtgaccaaatttttgcggcaattggtgatggcatatctgctctctccaatttgtattttacaacgcagggtgcaccgaatatgtacagtggaaaaaacacagcttcggaaaggctacaggttaggtatgatcgattaatgaaagaacgtaatgagaatgcccgggcttatttgagcggcctgtttggtgctatgcaggctgatgatgtcaaagcgagagatgatcgtaattggagacatcagttagcacgcgagaaaagagccgatgctattgcggacgcaaaggaaaaacgagataaccagatgtttgacctcaacgttaagctccaaaacaataaaatatcagcagccgaagctgatgcagaacgtaaaagagtggaggccgaatatgctgatgatcttgcaaaggctagacttgaaactgaaaaggctaaagcgggtgcttcaaaggcttctgcttccgcatccaatgctagagctgggtattataaccgtggtggtagtggcggcaataagaaaaggatgacacttactattgatggtaagaccacttactatgatacgaaagaagattatgagagagcggtgcagcgtgaggctaaacggttaggtattaagactcaccaatatgtgaaaaccacagaaaatgatgtaatgggggcaaaagaaaagaatgtctctactccaaaacctatcagccaacttgccggtgaagttgaaacggcatcgaataagaagaaaagtccaacagccggagataacagtagtaataaaaagaaaagtccaacatcataaatgaaacattatgcctgaaaatgaggataaaataaagaaactatacgatacgtttgtttctgatggttacgatatggagagtgaagaagatttccgcaagaacttatcggattctacaaaacgcaaggcagcttatgatgctcttgtgaaagatggttatgagatggaaccgtttgaagagtttgagaataatataggttttggaaagattcaaacacctgcaccggagcctgctgtacaaacagaacaggcgtggcaacctaccgaacaagaaaaagcagagatgattgccagtacaaaccgtatgatgcagaatgtggaaacacagatacaagacgcaaatgaacgtgtagataatatacaagaatacgggttgaatcccggattgcaaactaaagagggtaaaatgcagtttaatcctgaaaacgggaaactggaaaaaacatatattactccacttggtaacaagactactagtaaacctcttgctgacatcgagagtttctggtaccgacaagctgccgatatgtcaatcggcggacagttacgcaaggctaatctccgtttgcaggagttaaaagctaagcaagcggaaagagcctccgaagtgcataaggaatgggtagaagaaacggaaaagaacaaagcgccgctcgctgccatattgggagcagccacttacacaccgcgccagcaatcagacaaggaaaacagcgcattgagagtagccattagagaaacagaagagctcatcaagaaccttgaagaacagaaagaccgtgaaaatggggttgatgtaggcttttggcgtggttttggtcgtactatgggtgatgtacgcacgtgggatttcggtatgggtgatatggcggatgctatgaccatgatgaatgccgacaaatttaaaggtgataatgccacagagggcgagcgtgaatcctatgatatgatgatgggtgcaatccatgagaaacaacaggcagaggaaagatacggtggaaatgccgacttttggaacagagccggtgtcatgactggatatatgccttcatttatgttggatttcattttgacaggtggcggatttaacggtttgtctacattctcaaaaggaagcactaaagtcgccgcaaaggtcataggtaaagaaacggctgaaaaaatggctcaacaggggttcaaatcatatattaaagagaatggtgtcagagggttaggacagtacgcaacagattggactatcaaagcgcttgggacaactgcagatgatttgcttgtacgtgctccgttgatgacaaacaccatacaagcaggaaaaacggtttctgacatcattgaccgaaagcttggtgatgtggttgttgatgaaaatggtaactatgatttctccaatgataagacctggggaagtgcaatatggcaaggtgaagccaatgctatcattgagaattattcagaaatgtttggcgcacatcttgatcccattcttacgcttggcaatatgagtaaactcgccaatgttctaggggcaaagcgattgggaggtgtactttcaaaagcagatgccggtgcattgaatagtataatggggcaaactcatcagatgttcaataaaatgggtgtcagtgattatgttggtgaagtatcagaagaatactacggtcaattgtggcgcacaatgctcaatcttgatgatgcttatcagcagaatccggacggcacacgtactaacttatttgcaactgggcaattccacggtgatatttggggtggaatggcactctctatggggttgatgggggcaggaaaacatactctgtctgctgcaaactatgcttccatgaagcatggcgtgaataaagcggacgcaaaggtgaacgaaatgctcggcaatgaaatatgggagccgttgagggctacgcttgaccttaccaccaacgagaatgtgggggaagtggcggaactcatcgccaaagaccaggaattcaccaccgaggaaaaagcagccgtactggagtatatggaacactctttgaacctgcgcggcttcaacctcggcacactcgcacaaaagcgtggaggagaacaagatgagaatgtgcaggcgatgaacgagagctatctggacggctacaatatcgcatccccacaggaaatgaatgacgcaaagaacatgcttgactaccagcgtcagcggatgattgatgttgtggggacgaacgatgaagcccttgaaggtgatgcggtggactggctgaatgaagcgcggaacgcacgtgagacaggcgataccgaacgagccggcaccatcatagactacctcaacgccaagcaggtatatgacggaatgattcagcgcgtgcgtgatgatatagacggacgggtggaacagagcaattcgatgatagatgcacgtgtgaaccgcaagacaggtatgatacagggggcaaccatgaagcaggatgaacgcaaggtgtatgttctcagtgggactcttgtaccatatacggatggtagcggtgtaagtgtgactgattctgacaatagcatcattgttcgtgatgcggacacaggtgggcttgaacaagtatctcccgatgctatattgtctattgatgatgtacaagacccatacgagcagaaggagttggctgcacaatctatcagagaacaatttgcacgtgaagctgcggataagattgatggtgttgtcacattcaatccgggcgaaacctataccattgccgctgaaggcggttcgcaaatacaggtcacaatagtttcagatgagaacggaatcatagacaatggcgacggaactatcaatgtgacagacggaacaaatgtatttcctgtggcaaaagaggctatccaacagtctgtggacgcatttaacattgcacgaatcgcagagtttgagcaacagagaactgaagaaaaccttgctttgcagcaggaagagcgggaagcaggccgatcgcaatatgcaatgaatgaccttgtgacactccgtgatgaaaatggtataggtattcgtggtaacatcaccgccgatgtggatgccgatggactatatgaagtttatacggaagatgccttgaatggtaagcgtgtgaatatgtttacccgtgaagagcttgattccatgctgatagaacacaatgggcaacctgttgagattgccaattcaagtgtgaatgataattcggaagtggcagcaagttctctggaggaacagcagttgcaagtgtctgcattagaacgaatccccaaagatgaacaaggtaatcctatctatgagcaggcggaaactcccgaccttgcttgggatgccattgttgagcagacagagggagacgaagctatggcccagtccgtggctaacggaatggttgcggacaaagaagcagcattgaagaaaatcgagaaaacgaaatctgctggtggaaacactattgcagagaagattgtagcagagaaagaacgcaaggcggcaattgatgcagccaaacaggaattgtccatttggcaaaagatagccggcactgccaaccgcagaaaaatggaagcagatgcggagcgcagacgtattgccgatgaagctaccgcattgcgcaaggcggaagaagaaaaattgcgtgcagagcgtgaggaagcagaacgcaaggaacgtgaagcacttaacggagttcccgatatagtggaagatgttcccaaagatgcccgtgcaagaggatatagacgtgtaaacggccataaggttgacagacaagaaccattacaggctgtacaaggtaaagaggtgaacgtgaaattcagcaatgatgtagtggttcctggcaatgtaaccgtgattgatgcgtcattgttgcaaccgagtcatatacaaggtgtgcgcaattctctgcattttattgatgaagcacaaccaaaggaacgcaatgacgaagcaagcgtattgtctgcacggaaaatcgccgagaacattcgtccggaagaaatcacatcaagtattaccgcttacaccggtgcgccgaccgtaaacgaacgtggtgaagtaatacagggaaacaaccgtagtgatgccttgcgcctgatgtgggaaagtcattcggaacaggccgaagcatataggcaatacctgaaagaccatgcggaagagtttggactgcgtgccgaggacattgcgcccatacaaagcccggtgttggtaaatatgcttcatgtggacgatacagaagccctcaatcttggtcagtttgttgcacaagacacagaaagtggaggtgttgaacgtatcaaacctaaaaacaccttgcagcgcatgggaaccgaaatgcgttcgtttgccaacctgttgcttaggacttcggatgatgaaatgtcgtttgccggacttgtggatgccaatggtgcaaatgttctgaaatggatgagtcaaagaggtttcatcagtcacacacaatacaagagtgcgtttgacagcaagggcaacctaactcctgaatccaagaatgatttgcgtggtatcatgtatcaaagcatcttcaaggacggcagcacacggttggaggaaatgttcaacgtattgccggtaaaagcacaaaaggctattcttgccactgctttccgtgattatgacagtccgaacagtgaacgaatggtagatgagatacagaattccgttcgtgcttactatgctttgtcccaagataaaatgtttgcagaggcaaagaatttcaaggaagcacgtattgctgtagaaaactggaaacgccagtatcaaatggatgatgttacaggggaaagttatctccctgctgataatttcagtaactttgtcttgcatttggccgcaatgtataaaggtgaaagccaaagcttcattcaaaacacattcggcaagatttatgaccttatacaaggtacacaggaagaaactctgttcgaacagccggacaatacccctcggacgctcgtacaggctattaaagaagcattaaatttagattacaatggacaacagcgaagcaatgtattggttggcgatactgcaacaagccaacgagggcagcaaggaagcaatggagatcttgcgccaagagaacgagttgaggacggaaatgggacaatcgatgatacaggaagaactgaaagcattggtgaacaaagcgaaatagaaccttctttatcacaagaagaaatgctatcttctggtgatactgacaatcaacttagtgcaaaaatagcaagacgcattgaagttcaagaagatgattgggttgaaagcggaaagtatggcgatacttataaacagacaattattgttgatggtactcataaagttataaaagttgatgcacccgatacgaaaggtaattatacaggtagtacttatgagtatgacggtcaaacattcggagatttattggatgttgttaattatattgatgcatcttcgtctttagccaatgccgttgcagtggcagagaaagaaaccgatactactcctacggagaaacagaaagaagccggcaattataagaaaggtcatgtgcaggttggtacattcaatatcaccattgagaacccgaaaggatccgttcgtagtggaatagacacagagggcaacaaatgggaaacgaccatgcagaacacctatggctatattcgtggcacggaaggtgtagacggcgaccatatagacgtgttcctctctgatgatattgacgggtggaatggtcgcaaggtgtttgtggttgaccaatataacgaggacggcacgtttgacgaacacaaggttatgctgggcttcaatgaggctgacgatgctgaagcagcttactttgctaattatgacagaaattgggcgaagaagcacaagacaatgctgacgggcgttaacttagaggagttcaagaagtggatagagagcagccatcgcaagaccaaggctttttcggaatacaagtctgtaaagacgatcgaggggcagagttccggcacacaaggcaacagactttcagaagtcaagtcccgtattgaagaattgcacaaggaacaagaagcagcgcacaaccgtagcgacatttttgaggaggctcgcattatttctgaaattaacgacctctttaccgaacaacgcaagttggaacaagacgtttccagtgaagaagcgactgcaccgactgatgctccgtacaccattactccggtgcagtacatcaccaagcgaggtaaggtgttagatatgcaacttgttgagttccaatcggaattgcgcaaggaagttcaaaagcatgtaagtatgttcgccaaagaaatgaaaggttggtgggacagggaaaaacacggctttatgatgcgtagcgaagaggatgccaagcgattagtagaatacgcagtagatgcacaaggacaacctcccatatcaatgttggatatacaggctgtaaatgatggtgatgtgctgtttactaaacccaaagcaccagcaaaggatgaaaaacaggattacacccctgtatggcaatactctgtttctgttgataaggaaaccggatatacgactttgactcgcgatgatgtgagcggtcccatacctattggtgatgcaggttttcgtcagacaaccaacagcccggaggaaatgttaggcattcttcgcaatccgcagaatggcatgcaagaagttttggatgcagttggtgttccgcttgaaaataaaattaagacccgagaacttgatcgcaaggcaaaggatgaaattcatgacaaaaggacagatttcgttgttgataaggaaatggataacagatattctgttcgtactttgatgaagatgattgacgcggaaaagcaggctgtgatggatttaggagagaagcgtggtggagacgtttatcatgaaggaaatattatttttctgaccaaagatagtgcagacaagtttgctaatgaagctcgaactcttatcagcgatatgaggagtaagcagcaacaaggcaattcacagaaaaagactgaagcgagtggtaaccgtcttgttactgatgagcgttatgcggaacttcgtgagcgtatgcgtaagaagttactcggtcaaatgaatattggtattgaccctgaaatacttgccattggcacagaaatggctgtttaccatttagagaaaggctcacggaagtttgcagaatatgcaaaggctatgattgtagacttgggtgattccatacgtccgtaccttaaagcattttacaatggtgcgcgagatttgcctgaggtgtcagaaaacggattgaatactgacatgacctcttacgatgaggtgcagaagttcgacgtggccaactttgacaagtccggcattgatgcactcgccaccgctgaaactgtaacgaaagaggcggaagtggcgggggaggttgaagttgcactggaacgtataaagaaaactcgttcaacgcgcaagaagagtgagaaaaaaactgtaaatttacagcagtcaaacgagcttggtttgtttggcagtttgtttgataataacgaaaccaacaacgaagatggacgaatacaccaagaaagtactaagattacagggacacagcgagaagtcaatagcgaaaatggagctggaggaacggatagacgcagcatgctaccgccacaaagcggaaacgctagaagcaccgtacacatggagcgaggaagagtggacggagatttacaaagaggcagggatgacggacgaggaaatcgtagagtacaggaaggaacaggcgaaatacaacgggggcgaggaacacgactttccgatgatgccatagatgaaccgaaaaatactcgcaataatcattcagaccgggggacgaactatgctccaacttcggtagatgcacgcatagaggccaatattaaagctatagagttggcacagcaacttattgagagtggagagcttgctactcctaaacaaatggcagtacttcgcaagtttagcggttggggtggtttaggtaaagtatttagtgataatacatattcgacacgtctacagcagttgatgggcacagaagcctatcaagaagctgtaatgagtgctaatagtgcgtattatacccctgcttatgttgtagatactctttgggatattgttacacaaatgggtttcaagggtggttacattcttgaaggttctgcaggtatcggaaacattttggggcagatgcctacaaatatcagcgagcacagcgacatccatgctattgagattgacgggacttcgggtggtattctctcactcctttatcctgatgccaaagtagagatacagggttttgagcagacacgtattcctaatggaagtgtggacttggctattactaatgttccgttcgttaccggactccgtgtgaatgacaccacgggcgacaaagacctgtcgaagaaattccacaacatacacgatttctgtatagcaaagaatgtgcgcaaactgcgtgagggcggtttgggtatcttcatcacgtccaatggtacgcttgacaacagtaagaaactccgtgactggattgtgggcgagggaggcgcagacttcgtgggtgctttccgcatgcacaacaagactttcggcggcaccggagtaacctctgacatcgttgttatccgcaagcgtgtgaacgggcagaagtctgtccatgccattgatgtaagtgatgtgagcggagagcgcatggcagagtacgataccggggaaacacgcaaggttaaaggcaaggagataccagtcattaagcagctttcaatggactacaaccgctatttcattgaacaccccgaaaacatggcaggtgaaatgcactttgcatttgagaaaggcgatactttccgcccgaccagcaaaggcttatatcctaaacagaataagaaacaggaagaaatgttggctgaatttgtccgctcattccgtgcagaggaatttggtgagcgcaataccgagcttgccaccgatgtaatgcccggcaagaagattggcgaagtgtttgtcaaagacggaaaactatacatcaactcaactgcaagcgcacaacctctcgaagtgaatgccaacaaggtaaaggggcatacgaaagtggaatgctttgaggcatacaccgctatcaaggaagctcttgcggaagtcctttcctatcagactgcgaatgaaagcgatgagggacttaaaccgttgcttgacaaactcaacaaagtatacgatgattttgtcggcacatacggacacttcaacaagaacaccgccattgcgtttctccgaaatgatgtggactatgccaatgtatacgctcttgaaaagtttgaagaaacggcagatgaaaaaggaaaccagatacagaaatttgacaagaccgatgtattcagcaaacgtgttgttgaaaaagagaaagaacccactcctaccaatgtcaaggacggtatcattgcaagtatctttaaattcggtcgtgtagatataccgtacatcgccgaacaacttggcacaggtatcgaggatgtgaagaaagaaatcatcgagagcggttacggtttcgagaaccctgtaacccgacagatggaagcatcgtatcactacttgagcggaaatattcgtgaaaaactgcgtcaagcagaggtaaataacgagaatggggaatttgaccgcaacatcaaggcattgcaggaggtcatgcctatggaaatccccgcacatttgattgactttaccctcggaagttcttggattgacccgaaactgtatgaggattttgtaaaggaacgcacggaggttgacgtacggtttacagctgtgggcggtacttggtttatgaaagaaccatacttcactgattatgagaagaaccgtgcaatgggggtaaccagcgaaatgcttaaccgtaccattatggggcatactctcattgaagctgccattcagaacagaagcatcaccgtttccaccaccaagaaacactatgacggcactaccgaaaccattaccgacaaggaagcgacacaggcttgtgccgccaaaattgatgaaatccgtcaagatttcaaggattgggcaaggcagaagatgcagagcgacccggaaatgtcggcattgattgagcgtatctataatgacacgttcaataactttgtgcctatgagcataccagatgagtttgtaccggagtatttcggaggtgcctcgcacaagtttaagatgcgtccgcatcaaggcagagccattataagaggcacacaacagcctttgttgcttgcccatgaggttggaacagggaaaacctttactctaatttctacagcaatggaaatgcgccgtttgggtactgcacgcaaacccatgattgtagtgcagaatgctactgttggacaattcgttgcaagtgcaaaggaactgtaccccaacgccaagatactgacacttgaagaagcagaccgcagtgcagagggcagaaagaacttttatgccaagatacgctacaacgattgggatatgattgtcattccgcagtctacctttgaatttatccccgacagcgaggaaagggaaatgactttcgtacaggacaagattgaggagaagatgctcattcttgaaaagatgaaagaagaagacccggacggaaaaaatatgattacccgacaggctgaacgggaaatcgaattattggaggagcagcttgctggacttgcagacaatgcttcaaagaaacgtaccgccaatgatgaaaagaaacgtgctgtagctttgcagaacgcagaggttaaagctatggaaatgcttgaccgccgaactgacgatgtggagaactttgacgatatgggcattgatgctttacttgtagatgaagcgcacgagtataagcacctcggatttgccactgccatgcagcgtggagttaaaggtgtggatccgtcatacagcaagaagtcacaaggcgtgttcctgaagacacaggctatcttggaaaaaaacaacggacggaacgtaatcttcgcaaccggtacacccatcagcaacaccgccgcagagatttggacgttcatgcgctatctcatgcccgctgatacgatgaaagagtacggtatctattactttgatgactttgtgcgcaactttggtaacattcagcagatgctggagttcaccacaagtggaaagttcaaagagaacaaccgctttgctgggtatgtcaatttgcctgaactggtgcgtatatggtcgggagtgtccgataccgtcctaaccaaagaagccggcggcgtaaaggacaaaatacccgaaatggagggaggaaaggcacaagacctttatctgccacagacacgcgcattacgtagcatcatgaagttcgtaaagaacgaacttgaacattatgaacagatgagcggaaaggagaagaaagagaacagccacatcccgctcacgatgtacggtattgccaaagccgctgccgtggatgcccgattggtacaatctgatgccgaagatgatgtaaacagtaagactcatgaagccgttcgacagacattgcgctcactgaaagaaacagccgattacaaaggtacggttgccatttttgccgacaattaccaaaacaaacagagtggcttcaacctttatgatgacatcagggataagctgattacagagggggttcctgcagatgagattgtgataatgaggtcgggaatgactgtcaagaaaaaacttgaaatctttgaaaaggtaaaccgtggcgaggtgcgtgtgattctcggttcgacctttacactcggtacaggcgtgaacattcaggaacgcttgcacacgctgatacatttggatgcgcctaaccgtccaatggactatacccaacgtaacggacgtattttgcgacagggaaatctgcacaaggatatgaataaacctgtacgtatcttgcgtttcggtgtagaggatagtctggacgtaaccgcctaccaacgcctgaaaacaaagggggccattgccgatagtattatgaatggcaagcagatgatgtcgaacagtatgaccaaccgtgtgcttgaggaggaagaagatgtgtttggagatactatagcacaactctccggcagtgagtatgctatgctgaaaaacaatgcggaaaagaatgtacgcaagtatgcaagccgtaaaaagcaatgggaaacagaccaagcctacatccataatgccaagccaaggttaaaagcctttatcaaagatgctgaaaagcgcattgaggataacagccgatccttggaggctgtacgggtatcattccccgatgaacaattcaaagagattataatcggcaaacatcgctttacctctgttgatacaatggatgatttcttcaaggaacacaacaagactgttcttgctgaaatgaagcagatgaaagacggtgatatttcaggggaacaaaagcgagaactgactatacagataggcaatttcccattcattgtatcaactaaattgacaagacagaccatgcgtgatggtacaactttgttcaatgacgttgagagaaaaatgacttattcatgtacagaacttggtatcgaggatgttcctgtacgtcaaaatctgctccgtaatgccattgaggatattaccggcaatgtgattacaggaaaaaactttaccgaaagattggaagccgctgagcgaagcaagaaacacaatgaggccgaattgaaagaactcctgtcaagagagggaaaaccttttgagtatgaagaagaattggcacaagcgaaatcgcagttggaagaatattccgagctgatgaagaaggagatggcagagaaagaagccaagtatgcagaaatggatgagacagtagaggttgcttctgatattttcacttctgaagatgaagatgaactattgcgtgacagcgatacgctttatcgcatccgtcaaagtgctgcaccgaagaaaacaggcatagggtataaggtattcgtcttgaaaaatggagaactctatcctcctatggttgctaatcctgacggggctgcaacgcccgtgggtgtatggctcgatgctgatgctgctcctattgctggacagagcaagacgggacgcaatcaagtaaaagcaggtggtaaaggcacgcagggcggaagtggaaaacttgcttatcgtccagggtggcatttgggcgagattccatacgcattacaattcaatcgtattgacgagaacggtaataaggagttgttccctgctaattttgtatgggcagaagttgaatatgctaatgatgtggactatcaggaagaagcaatgagttatggtatcaatccaagcggcaagttccaacattcattggcaggattgccacgtgttcccgaaaacggtgcataccgctaccgtaccaatcctaaccccgaaactgatccgtggattataacaggtgctatgcgcgtgaagcgactgttaacaccgtcggaggttgatataatagtagagaaagcaggacgagaaccacagcacagacaagaaggtgcggtaactgatattcaaatcaatgcccttaatgcagagattgaacgtaccaacaacattagcccccaagtacttcgtaagcaaatgacagaacgtgtgaaagaactggcagcattactgcatcttgacaatgtagaggtggtcacgaatgtgagcggattaaaaggcaagactaaaagtgcacgtggcttttacactaagagtacgggaaagatcagcgttgtgataccaaacaatacaaaccttgctgacgtggaacaaactttgttgcatgaagcagtcgctcactatggactacgcaagatgttcggtactcactttgacactttcctcgacaatatattcaacaatgccgatgaaaacgtacgccgaaaaattgtagaacttgcaacaaagaatggttgggatttccgcaaggctaccgaagaataccttgccggacttgccgaacacattaatttcgaggaagcacgtaaaaacggttggtggcagaggataaaacaattcttctttgaaatgctcgacaaattgggcttttccgattttagaggggttactctgacggataatgaactccgttatatcctttggcgtagttatgaaaatctgaaagaaggtaagcacagcaacctgttcggagaagctgccgacattgctatgcagcacaagttgagggttggcgaatttgccgacacctcaaccgatgatgtactgaaccgagacggtgatcccgaaatacacgagcgtactttggcacgagcaaaatatgaacaacgtgtgaagagtggaatgtatcagtcacaggaagccttgcaggatagtatgcttggtctgaaagaagcaatgaccgcaatcctcggcaagaatacccgaatggaagatgttgatggatttgaaaatgcttacttaggtgagaaccgcttatcaagtgtgaacaaagccgaagccgatgcctttgcgcacctattgttcaagccaatgcttgaagaggtagccaaacttgcgcataatacagcagagcgcgaggaactgaccgattatatgatggctaaacacggtcttgaacgcaatagagtaatggcggagcgtgatgcacaaaaggacttcgcggaatatcagaagcagcatccgaagagtacaaagaccttgcaagactttatcgacgagtgccgcaagcgtgattatgcaggtcttaccgctctcgcaggtatggaagagatcgcagatgcagaagccgaagcacaggttatggtagatgagtacgaaaacgcacacgacaccaccgcattgtggagcaaggttaatgccgtcagcaaggcagtcctttccaagtcctacgaatgcggaatgatgagcaaggaaacctacgacagtgtaagagatatgtatgagttttatatccctttgcgtggatttgatgaaaaaacgagttctgaagcatacgcttaccttacacataagcagagtctgttcaatgcacctatcaagaaagcagagggaagacgctctaaagcagacgatccatttgccaacctacaatccatggccgagagtgccattatgcagggaaaccgcaacaaactcgtgaagcagaagttcttgaactttgccctcaaccatccgagcgaccttgttagtgtgagtgatttgtggttgcagtatgatgcggttgctgatgaatggaagccgatattccccgacaatattgacatcaacgatagtcccgaagaggtagagcgaaagatgaacgaatttgaggataagatgaagcagcttgctgaatctgcccccgataattacaagcacggcaaggatgcgataaacattccgtaccgtgtggtagagaaccgtaatttgcgacagcatcaagtggtggtgaagcgaaacggcagagactatgtgattaccatcaacggtaatccgagagctgcacaagcattgaacggacagacgaacccggataatgatatcagcggaagtatcggtcagcttgtacatctcattggagatgtgaatagaacactgtcctcattgtacaccacattacagccggactttattgcaagtaacttcttgcgtgatatggtatattctaattctatggtgtgggttaaggaaagtccgaaatatgctattcaatataacatgaactttgcgaagttacctattgtaagaatggttatgttattggataaatactgcaggggaacgcttgatatgaatgatgaaatagagaaaatgttttatcagttcatgatgaacggtggcgagacaggattttcaagaatggcagacattgacgagcataagaaagaaatcaagaagatgctgaaagcggcgaatgaaaaaattcctgcccatgtggtacgtgaatgtatggctacctggataggcgaagtgggacgaggtatagagatgcgtgctcgatttgccgcctttgtaacaagcaggaatgcgggacggacaatagaccgcagtatttgggatgccaaggaaatcagtgtgaacttcaacaagaaaggcgcaggtgataagttcttgggggctgaaggacaaaccatgttgggaaatgtagcagccggtgtatcgggtgcaggacgagccggatatatcttttggaatgccgccctgcaaggaacgttcggaaacttcttgaagtatgcgatgaggcatcccggcaaaataggtactgtcgttgcatcatggtatggtttagccatgcttgttaccgcacttgcttcggctggaggtgatgatgacgatgacagctactatgacatacccgaacatactcgcagacagaacctcattgtcaaggggcccggtaacgcatggataaagattcctttgcctatcgagtaccgagctgtgtatgcgatgggagaacttaccggttcttccttgttccataacgagaaattggaggttagcgatgtattggcacagatgagccaattgcttcccgtagatatgatggaggggacaaaagcgttgtggccaagcagcgtcaagccgatggtggaagtatcgaataacgagagttggtacggtagtccgatatggaaagatacaccctacaataaatatatgccgaattggacgaaagcctataagagtgcgaataaagaccttgtaaacctttctgaaacactgaacgaagtcagtggaggaagcaagtataggaaaggtactattgacttgaatcctgctgccattgagtatctattgaaacaatacaccggcggctttttcactgtaaccaaccaaattcgtaatttgatcaatgtgggaacaggtgaaaaagattttgattggcgttatgttccgcttgccaaccgaatgttgatgagcggtggcgatgaacgtaatgtaggtagggggctggatgagaagttctttagttatttggatgcataccgtgcaaaggcgagtgaattcagcgccattaaaggtgatttgagtttaccgttggagaagaaagcagaactgataagcgagattatcattgatcctgaatatgtaaaaatgaaaggaatggaacgtatttactcaaaactaaagaaagcttatgatactgctaaagaaatcggagatacctcaaaagcagaagaacttgaaaagaggattaatgagttaaagcggaaattcattttagagatggagcaagacgaacgtaaatagttaaacctaaaatgattgcttggggtactacttttgtactcaaagcaatcattaaacaacgaaaatatgcataataaaggcaaaggaaaattgttaccaatgagccgaattgcgccgaaacggaatgaattatctgaaattgataccgttgcttccgcaaagcggtatggtgaccgcagagcatttgatattctaatggaagcgcagtactattggaatcagatggaggactttcgaaaagaccgggaacgcaataaacgctatacttatggttttcaatgggatgatatgatttgtgttgatggtaaatccatgactgaagaagaatatatcaagagccaaggtaatgtgccattgaaaaataatcttattcgtcggcttgtacgcagcgtattgggggtataccgcagccaaagtaaagaacctacctgtacagcacgtgatagagacgaacaaaaacttggtgaaacaatgagtactatattacaatgcaatatgcaactcaaccgaatgcccgatgtgtatgctcgaagtatggaagagtttctaatcagtggctttattgttcatcgtaaatcatacggctggcgtaatgggaaagaagactgctggacggattatgtacagccgaacaatttcttcattgataacaatatgagggattttagaggttgggatgtgtccgtgcttggagaagtacatgatatatcttttgggcaactgtgtgaacaatttgcttccagtccgcaagaatatcgggagcttcgtgatatttataagtgggctgcaagaaaggattatatagccacttacgcagagcgatttgggtatagtcggttagaaaattacgattttctctttactagtgagccgggaaggtgcagggtaatagaaatatggcgtaaggaacaaaagccgagataccgttgccatgattaccaaaatggtgacattttcaagatagatgaggaagattatgtgcgagtagtacttgctgaaaacgaagaacgtatacgtatggccaaggaggtgggtatgcctgaagaagaagtaccgttgataaaagctacttggtttgtagatgattactggtatttctattatctatctccattcggtgatatattgagggaaggggagacgccctacgaacatggcagtcatccatacgtttttaaagcttatccgtttattgatggtgaaatacactcattcgtggcggatgtgatagaccagcaacgatacaccaatcgattgataacgctttatgactggattatgagggcaagcgcaaaaggtgtattgatgatgccggaagattctttgcctgatggggtgagcattgacgatattgcagagagctggacggagttcaatggtgtcattgtatacagaccaagcaaaagtggcaaggtaccggaacaggtagccaacaactccacgaacataggtattgccgaactactgaatatgcaattgaaattctttgaggatatttcgggggtaactggtgcattgcagggaaagccgggatattcgggggaaagtgcatcacattacaatcaacagacagagaatgctacaaaatcattactagatttgcttgagtgttttagttgctttgttgtggacggggcatacaaagatgtgaagaacatgcagcagttttatgatacgaaacgtgtgttcaatattgctggtaggagtggtgcgcaaattgaatatgacccgaagaaaatccgggatgtagaatttgacttaagcattactgaaagtacttcaacaccggcatacaggcatcttgctaatgatatgctaatgcagttgtaccagtcccaagcgatcagcgtagagcagttgcttgaacatggagatttcccgtttgccgatgaactgttacagagtatcaagagccaaaaggaacaactcgcacaggggagagttcctgacgggctttcacctcaattgctccaacaagcgcaacaaaatgcaaatatggaagctgtaaatcagttgcatggggcaatgcaaggctaaattctaaacggcgaatagaaacccgctctattcgccgtagaaaattactctttggacaattggtcgcattctatccatgtttctaatgtatcatcgaatagtactgtacaaccgtaattatcatcgtctactgctaacactgtccctgaatttccatcatcattacacacaactcgatcgccagcttttatttttcggatattgtcaatagctagagggtcattagtaagtgtgacaatgccgtctatcccctgttttgcgtcatatctacttcccattacttttttctttttttgagtgaatcaaggtaagtgaaatattctttgcgcttgagtttcacaattaattcaggtaatgcgccgcttccatttttataaggagtacaatagaaacactcacgctccaaatcattcacgaatgttgaacgagataaataacctttctgtttcagtttgcggaagttgaatctatccataatgatgagtttaccactctttccattgggcataacgtaataacgttcacctgtttcctcatgtgctttgtctgcttgcactaccgcttcatttaaacggattgatgcacgtaattttttgataatgttcattgtttattagtttattaaattaaatgtttaactttatattgttgctgccgaaacagctttctttcttcttttaacagtaaatcggccaacacgaggtacaattttgggagtatccatttcaaagaagcagatatgcagtccgatagcccttgtcattaataagtcatcatgcttaccggtaattgcgccaaaagcgccgttcggctttttctcataacacagatattcatccaaacaacgttcatcacgttctgtgtacaggttttcacgaataactttgactaatgttgatataatcatcggtttagtggaaatgttggtatgaaaaccgtattttgtaggtaatccctcgcgtacatcttcttctgattgtttgcgtgcatacaggttgggatatatatcctttatttggttaagaataaatccggattggtcaccatccacttgccgctccttatcatgagtttccaacgtgttgctttctatcaccaaaagcgaattgtcataaaacgctgctatttgtgccgctttccacgcaagctggtcgatgtcgcaatgtccataccattgggcaaccacgactggcctgtcgccatcaatcatgaatagacgatcgaacacgacgatgacagagaagtcggctttattggaacggcctcccacatcgacaacagtgaggtagcggtctgtgacaacttccttttcatctatttcaggaagttcccaaatatgtaacaacccctgtttgtcttccataaaacgcaagttctgcaaagcgttcttgccttcgtctgtatcggcgtagacttcgccgacatatttgggcttcttgcaggtcttgcgcattgcatcgaccttgtatttgtcgaatatacgcgctcctgaatgaacaaaggcttcaatatcgtcggacggaaattcggcagccatttgtccatggtcattatacttcctacgttcggctatataccagttgatagcttcgagcgtagcccctttctcccataaccaccaaagatacttaccgcattcttcacgttcggaactagtattttcattgttacggtttttatagagccattctgcaaaaccctgtttttctttatccgaattgaaagccagcgtgtattgttctatgtcgaaccatgatacgaacatggcttcgaactgggaatcccctttctttgctgcggtatattccctgtgaaagaaatttcctgtaccattcgctgtactctcatagacaatcatagtgtatggttttaggagaatacccgaacaggccgaccgcacaatatcttctggtttcttaccttccgttgctttccatatacctacttctgaaagatgtacaaggttataatctccacctcggcaactatccgggcgttctgctgtaccaattttaattttacagtttcgttgaggaacacggtatatgctacccgacttacccactcctacaagtttcggctcattctcattgtaaagctcatcaatcttgtgaagcatttcgactggatattttttaatcatcctgtcgaacatatctttgatttcatcggaacctgcaccttgatgtgctattatgagtgaattcagtcctattttgtgaaggagttgcaaccatgccatataaagctgtgaagtggtagagccgccccattgtcgcgcctttagtagaataatacgtattggctttcctgcaatacgtaatttttcgagccgttccacaaagcgacgttgcggtcttgtaagacggaacaatacatcttctccaccacctttattcttgatataaacgaatgtagctgcccaaaatggaaagtcctcgcggctacgtatgcgtacaaattgctctataactttcagccgatcatccggattgtcttctactcccatgtaatccgtaaggaatttggcaatagaacctgcttccacaagttgacgtacaagcggtattttcattacacgctttggtagccattgattgcgtataggaaaatcactaatggtacatttgacacgtccccctacagaaccttcgccggtaataggattaaattttgcataaataattgaattacggcgttcattctctattagtatattggtaatggcttttatgtttatattacctttaatcatgtgacttttttattatcggcttgttaagcagagccacaaggaaacctaacatataacaccataggtgtaatattgcattggtgtgtggaaataagaaacctgcagtaagatagaatatcatccacaactggtaatattgtttgcgtaatacttcaaacgagattgagccaaataaaacaaatactattcccgataatcctactgttggtgatgttatttcaccaataaaacactcaatagtgtcaactggaatcgtaacagcaattatgtaagctagtactaaccgccatattccaatgtcataaataaaaaccattgaaagcaaacaccatgaattaagggaagcgtgcagaatgtttgcgtgaaaaaatgggtacaatacacgtccggcaatatcacttcctgcgtaaatgcctacagtttgccaatcccatactttgaaaaatgacaaacctacaacaatagtagaaattacaagagccgtaatcttttccatttttcttgtatccattgttttcttgctttacataccattacttttgcactgcctggcgtaaggtagaatttaggagcaggttgtgcaataactttggcgcacagttcggaaatagttaattcaggacattcttcttgaagcttaaatacccgattataaatttcttcatacatctcttttttcaatgggcacattgtgctcaaatctgttttacctctcatcattgcagaaataatcaatgcagcacgtatgtcactaacccaaaagcggcgagagggcatattgactattattttgtatacctcggacatacggatatagtcgcatgatgaaatgtattcatcgtatgctctcattaaatcgtccatacgttcctttgagtattccattatagcgcctttatgcttcatttttctatttatctatgttccaaagttatagattggagcgtaaaaagataaacgtggaatccttctttccctcgctatttttgctttgtagataaagactaaaatttatttttctcacattatacctaataatatggaagttaagagcaatcgcgagcgatacacagatcgattgaaagcaaagtatcccgataaagagtttgccgacgacgaggcattattcgctcaaattaacgatgaatacgacggtttggacaaagaattgtctggctataaagaacgggaaaaagcactttccgatctttttgcgagtaatccacgtagtgcagcatttctcactgattggcgtaaaggggaggacccaatcatcggtatgatacgcaaatttggtgatgattttaaagctgcacttgaagacccagagaagcaagaagctcttgctgctgccaacaaagagtatgcggaacgaataaccaaagagaaggagtttgaagaacagtatcagcagaacattaatgcgactctttctactcttgaacaaatgcagcaggaggaaggtatttctgatgatgaaatagatcaagcaatggagtttctgattggaattatgaaggacggacttcttggtaaattcactcgtgatagtattcaaatggctatcaaggctatcaaacatgatagcgatgtagaaacagccagtcatgagggagaagtgaagggacgtaatagtaagattgaggaaaaactacgcaaagggagcaagagtgacggtactgctaatcttgcaggaaagaatggaggtggtaatgcaggctcacgacaaatgccagatcttggtgcaataagtcgatatgatggtgcacaaaatatttgggaacgtggaggcgaaaaacgtaggtcaataaacaaataaagatacacaattcatttattaacaattaaaatttcaagcaatgaagaaagtaatgaatttcttttgtcgcattacgctaatgatattagcgtttgtgacgagtgcatcaagcggtgtcatgatggctgacgcatcaaacctgccagatgcaggtaaaatgacagccggtgcagacggtacgggtggaacagatggtattgccacagaaaccggtggtcgtgaaaatggagacccgaatttttacttaagcgatgtagataagcgcattgtgaaaattcgtccgatggcgacacctattgatcaaattagtcgttatgcgaaatcaagtagtactaattcttttgaggtgaagtactatagtgtgggtacacgcgaaataaagtgtagtactaataaaaaattggaagcaatgacgggtggtgcaagtgtttctttgccagtgagtgatctgaatatgttcacattggatgacactatccgtgtggtaggtgtaagtgctattactaaaccggatgggactgcatattcagaaagtgacagcaatgttcctgaccttgaactttgtgtgtgcggaaaggatagttcaactaatttgccgacagtctatgcagtaaatgggaaaatggatgattcaagcaagcaacccattcttttaccagagattccgcaaggaacgactcttgtccgtatgggaaaggcctgtggtgaactggatgtgcagactgggcgtttcaacaatattcctatgccggaaacacagtactgtcagaacttcatgatacaggtagaacagtctacctttgacaagattgctgccaaagaagtgaattggaacttttccgatattgaagaagatggcgtatatgatatgcgccttgccatggagaatacctacttgtttggcgttaaacaggttatcaaacatgttgccaaggacggtatgaatacctggtttacagggggaatctggtggatggcaggaaaggatatcgaggttggtgaatggaacagcgaaaagaactgtgccgagattactgatgaaaatctcgtggatataaccaaagacctttttgtcggtactggtatcggtaataagcgtaagattttattctgcggaagtgatatgctttcggcattctccaagattaagagtgagaaatttcgtttgaaagataccgttgaggtttggaacttgaaatttaaatcttgggatactgacttcggagaagttcttaccattcatcatgaattatttgatgtgaatggtatgagtgattgcggttttgccatggatccggaatacctttccaagaaaacccacgtgtcttgggcacgcaatgtgcttgacttgaagaaagcgggtattcgtcgtaccgatgcagtagtgattcaggaagtaagttgcttatatctgcgttatgcaaaggcacatgcgcgtatgagacttgcaaaggcacctgcaacagtagaagatagtggttcagaaactgcttaattagagtataaataaatcaaattattaatcgggggatgggatagaaatcctatcccttttttaattcattcgacaatatgattattaaaacttacatagcgaacaccaatattagtattaatgttgtgcttccaagcaaaaagaattttcatataacgtttactcccttgtcaaatggtagtagtgtatttaccacagataatgaaatcttacaaaggtcaatagagagacattacaactttggaaagttgtttagactccaaacttcacaggggcaaagtgctgaaagaaaggcgacagacaaacaaaaggttacttctttaaagaatcagaaagaaattccggctgttgagaatgtagacaagactgaattggataacaacgagaacgttgagcaaaacggagagacggaagataacgcaggggcagggaatgatgaaactgtttgcaaggtcaaaatgagtgatattgcagctgctaaggattatcttgctgacaaattcggtatcagccgtacttctatgcgttctactaaagccattctggaacaagctgcagctcatggaatagagttcgaaggattgtaataataaagtaatagcgtatgacggtatatcatcttgacgagatagctggagatgttcgtatagcacttgaccaaaacacaacgagtgatgtattgaaagaaattggtgatgtagacacgcttgcattaaacgacatcattaaatcaaagattattgaggctgtaaaacgtgtgcacagttctgcacctccttatctactcgatggaggacataacttcggagatgaggtgtattggcagaaatgtgaaagtggttgggtgttattgccggaggattttatgcgttttgttgttttccagatgagcgattgggagcgtgcagtattctatcctataaatgtcgacgatcctgaatacgagaagcaatcttcccggttcaaaggaatacgtggcactacacaacgtcctgtatgtgctatttctatacgaccagaggggagggtattagagttttattcttgtaaaagtcaggatgcaacggtcagtcgtgcggtttatcttccttatcccaagatagacaaatacggtgcgatagagatttgtcagcgatgttatgacgcggtggtatatactattgccgcattagtattaacaacgttcggtgatgtggagaaaagctctgcattgaacgaattagctaaatcagtattaatatgagttcgataaaatcaacacagatagatggtgatgtttccgtcagtcgtaatgcggcagtaggtggagatgttaccgtccaaggtaaaatccatttaaaaggaaacgtaaaaatagaggggtggcttgaggcaaagaatatcaaagcagctagtaaaggtctctttactactattgaaaaattgaaagcagcctacccgtttccgcatgacggttggtgggcacttgtcgggctttccttacctgctcctatatacgtgggtgatggaggcgagtgggttccaactggacagacaggtggtaatccttctatagacagtggtaaatttaacgaagctgttgaaaagctacaagaagatattactaaattacaagatgatgtatcggatatagaggataaaaataactcgcaagatactaaccttactacacttgggaatagtgtcaattctttgcaggaacaggtaaatacaaccaaagacaccgccaacaaagcaagtgccaaagcgaatgaggtaggaaaccaattgaatgactttaagggaacgaaaggagaaaatggtggtattgcacctcttaatgagtatggaaaagtacctagccgttatttaccggcttctatggatgatgtgaaagatttcgacggtttcgtggaaaaagtggttgttcaaccatcgtctatcgggaaaagttcaacggatgatggatgtaagatttactaccataaggacaccgattcgcttgttcttttctatgacggtgtatattacaacaactggctggattccgaattgtttggaaatgaaactattgacgggataactcctgtttcggataaggtgtattctgacacaattacaaacaagacttatcgttggagcggttcggcacttgttatcattggttcagacctcgcccttggctatacaagttcgaccgcatttccgggcgatgagggtgcggatttgaagcagaaaatgctacaagccaatgaagatattacggaaaaccagaacgtattgttgtcccattacaaacagatagtagcacgaagcgtagtaaatgtgaaccaactctttggacttactaatcgtaagataacattctcggtggctcttgatagatgtgcgacatccgaatatgctgaatctttgcaaataccaggtattgtgcttacctttcagactgaagcaggttggcagtccaaacaatgggttatcactgatgattggaataaggaaagcaactggacggacttcggagcttccaacggagaaagcgttggcaacacaatcaatgtaaacgccctgtgcaaagatgtggaatatacgctatccaccgccataaaagcaattattgaccttgagcaagagagcggagtggcatacattaagagcggtattgtagtgacattcaagactgcagagagcgacaccaacggtgcacctgtatggcttgcctatcaatttacacgagaagtaagcgatgtaaacccggatgatttgaagccgtgggtagcctttggaaacggaggtggcaaggtggaaacatcggacaccccagcagagggaggaaaagatgcactttcaacaggcggtgcttacgcgatgcaggaaaaagcaatcgctggttttgacgaggaaagcgatgaggattatatctactacaaagctgtgaacctgaatggtggacaaatagaagatgtgatactgaaaatacctaagaacggaggtggaggcggttccagcgaggacagtaccctatccatttattttgaggatgtcgctcccattgtagcgttcggttctgacataaaaattaatctggccctacgtagtgtgagttatccgggaggtgtagaaacacttggcgttatccgtaatgtgagcataattgatgcaagtacgggactaaccctatttagcgaggacatgaatatcgtaggttctgcaagtgccacagactacaagtttgaacttgactttactggctatttcagcggagcggcgagcaagagtttctttgtgcaagctacagatgctgacggaaatactaagaagaaagccattacagtagtagccgtggacatcaccgtggagcagcctatggcattgaactacacaagtgacactgttcttaccgtaggtggatctgccaagaacatcggacagttttataaatttcccaataacacatcatccatacttgcgaccgtggaaatgtactacaacggagaatggaagaaacttggtgaagcaatggtaagcgacagttataccaagagtatatccgtaaatccgaacgatgtgtttggtggtggtgaacggctctcgcatggtgcatatcctgtgcgtatcttcggtacggaaagcaagtcgggggtaaaaggcaataccatctattcagcccttatgtgcatagacgagaataatagcacacctattgtcgccctccgtttcaatgacaagaacaatggtacattgcgtctgtatgacaatctgaccgtagaagtagctgcctatacacctggcaagacagaaacgcatattgatgtcttctatgatgaagaaaaggttacttctgttgatgccatgattgctgaaacgattaccgtgaacaagcagataagcggctataaggcggacggaagccaaagtattactgtacacgctgaaagtggaagtgtcagcaccaatgaaatagaagtgacggttaaaggaagtgccattgacattgccatcaaggacggtgctttgtttgggtatgacttctccacacgaagcaacagtgaaagtgaccacaccattatcaacaatggggtaaagatggaaatcaaaggtgcgaactggtcaagcaacggatttatagactatctgaacgaacgctctttgcgcattgccgagaatgtgacagccgagatattggattaccgtcctttcggaaatccgtccgtagaaagtgttagtggttgtgctttccaattcgcttttgcgaccaagaacatcaaggaagccagctcaaaactcatagagtgttacgatgccgacagcggtgccggattctatgtatgcggaaacaaggttgctattttctgcaaaacaggtcagccggcattggtagaacgctcttttaagaacggagaaaagcacactatggctatcgttgtggagccttcaactatctttgtaacccgtggtggcagcaactattcatgcatgaagctgtatttggatggcgaagaggtgggctgtataggatatatcagtaacagcggagctattctcaactcaaagactgtcacttttgacggaacagagggagacctatacctttattacatccttgcttacaacagttactacgagtgggcacaggcatttagaaattacttgtgcaaactgaccgacacaacggcgatgattgatgaatatgagagggagaatttgcttgatacgcaaaaccgtccgactcttgaatctcttgccgccaaaggtatcccttactatgtagttgtgaatgatcagcagacttttgacacctttgacggagatattgacacgagcaagaagttcaaatgcacactattctactatgatcccaaacgaccttggcgcagcttcaaggctatcaatgtgcaatggcgcagacagggaacgacatcggcaaagcgccctatcaagaatgaccgtttctatcttcagaagaatgacggttgggaagtttctcctatctatccggaatataccaacgaagatgcaaaggtttcgtatgacctgatgaaattaggctatgtacgtgtaggcgagaattctatacctgtgaaaatcatcacggtaaaggtggactattccgatagtagcaatgccaatgactgcggagtttgtaaccttatgaatgctacatatcgtgcccttggcaacaactatctgactccggcacaacgtgcctttgacggaacatgggtaaaaggagacatatcattgagcggattgacgatgaaccattcgactgccaaccacccgattgccgcattccgttcgactatggaaagtcttaccgatgcttggttccatgccaaaggtaattggaaagaggataaaggcgagcaggtggcactcggtttcaaagacacacccggctacaacaaagggtgtttgaactatggcgacttcatcgaatacttcggcagaagagacgaaacccttgatgaaattgaatcacgcttcaagagcgatagtaccacagacaaaagtaaactctatatgctctccctttattgtggcgagaactaccgctttatggcatacgagagcggtgcttggactgcacaaagcggagaaatgaagcaggtagatggcaagtggcagataacaggtaaggtgttgaatcctgtaagcggttatgaactgctgacttatgatgccatgaactggtggcagggagtgggaagcattgatgatatgatggaaccgaccacggcagaatcatcgtgggtaacaaaactgaaactcggacaaccgacctatccgatgtggacacgctacttcgagtgtatgatagacgatgaccaactgcaaatagacttggctatgggacgcaaagtaccttgcgacttgtttaacgtgttggtgttctgcgacagttgcgactatgccaaggaggaacttaaagacacttggaaggagatttggaaaacgaagatgtggaagtacataaatccgtacagccttgtgtcgtactatctctttacggactaccttgccgccgttgaccaacaggcgaagaatatgcaacctatgtggttcttggaggacggttgcagcgtgaaagacggagtatatagtggagcaaacggtatggaagccagaagaatgtactgcaacaaggtgtatgattgtgatacttgtaacggcaaggacaatgacggtggtcagaccattgatccagaggttgaccctggcgacttgacgagtagcgcgtacgcaggacgaggcagtgtgttgtggaacgacatacgcggacagcagactatggaggtggatcaaaacggtaacaccattacgctttcggctatcgctgacaccatgcgttcacttccggacacgctcggcattggttcggggccattctctccgaaaggtgcgctccattacttcgttacggaaatattgaagaagtggccaaaagtggtgtcaagttacgacggagagcgtaagtacatcaaatacaccggatacagcgatatttatttctatgctttgcagggattgggacttacttctctaccggcgttcatcgaacaacgttggagaatccgcgacggctactaccgttgtggcgacttcaaagcagagagcggttatataggcggtcgtatcggtgcgaaagagggggcggttatccgttttaaggctgcaaagacaggctacttcggaattggtaacgacagtggaaacatcacgcagggcatctatctgaaagctggagaagagggtgtgttcagtaatttccaacatggcgagaacatcatgctctacatctatcaagccgaccgtatgagtatgattgacttgagtgaaatcagcattgaccctcaattcggtaatacattgtcgaagatggtgttgttgcaggaacttttccttggtagcaacacgcacggagattggacgatgtcgcctggtaacactggctatatgaccaatcttgatttgggcgatatgccgttcttgcgggtattcgatgtgcggcatacggaactattgagcgttaacgcatcgaagtgtccacgtttggagaaagtatatgcggatggcacagggttatcgaccatagaccttgcagaaactgctcccattagtacattgacgctgcccgatacgatgacggaacttgtattggacaatttgccaaacctgacttatcccggaggacttacgctaggaggtgtaggcaaggtagcaaagatattcgtaaatgaatgtccgtatgtggatgctatgacacttttagagcagataattaatgcgagtgcgatcagaactgtacgtattcctaatgtaaatgcaactgctagtgttgatttgttacgttctataaaggatagtggagcaattgggcttgatgcaaacgggaacgcatacgatgagagtggacaatgtagtggtattacaggacgttggatattgagtgaacttgtagaagagagtgaagtaaatgtccttactgcatattttccacagttagagctccataattcgcaattttctattgtgaaaatcaatgatgttgtggataacgattcatgtgagaagtacagcaatcctgaaaacaagacaggtgaagactacggtaacacatatattcctagtgggcatactcttgctataaagaaaggttgccatgcttttaaatgctcgttcaacacgaagaagaatcaaatggaaggtgtacagttgagtgatacagactttaattatctgaaagatggtagtagctttgatgttgcagatacggcaggggagggttttgatatattttggcatgctcctcactattggtataagggcgtaaatgattataagaaccaagtgaagtattttattacttctgttacggaaaacgagcctatttcaactgcattacacagcaagaaggctaaactttctgaacttctgtacaaggagaatactggagtgtatgcgaatgatgctgttattggtgaggttatgagtgaggatgttatatctacagcttctaatactaacagctataagatggacgtaaaaggtatgaagcaggtgaaatggccgggattgaatcatgcgcgactaggtggtgtattcactgatgaaggtaattgtgtacttggtatattcattatgtccgtaagtcatacgtattttgacttttctataggtgagtgtgtattctgcgatgtacctagcggtgcaaaatggttctattttacttcttttcgcgacattggtgatgttgagtgtctttctgtggatagtgccagcattgaggctcttgagccggaatggactgaacatacagtaggtgataatgacagtcttgtaggtgtttatcctattactattgacggtttgaagatgccacgaagtctttctggcgaggtacgctcaaagaaaggtaatggtacatccactacgtcaggtgaatggaaatacgatagtagtggtaatcctattgagatgccgattgctaccttaaactacacagcaaaggatttccagaatatttcccgtttgagaggtgcaggttaccaattacaggattatgaacaacacaaagagattagtaatctttggtgggcattaaacggaacaaccaacgaacaatctgtagtcggtaatggaggacatgacgctattttaaataaactggattccattggtatggcagatagtagtaatgctggcaattctcttaattctatacttggtttgaagcattatgtaggctgtgattcagagtggatggattatattgcatttaatatcccaagttatgaaacattctacaaagcaagatgtattgatactgatagttcgtatccttcggattatatagcccatatttatgatcctgtgaaaaagactgaacgtacagtgaaatcagttgaatcttccaatgcaaattgtgtggtacgcttggtacatggagcaaaatgcgatattttgccaagcagggttcataatgcagatacgagtaagtatgttactcattatgcggctggttattggatcaatagtagcaaaggccgttgtgttttgcggtctggcgcccactcgattgcgaacagcggtctcgcttatgcgagcgcgaactttgcatcttcggactcgtacgcgggctacggggcgcggctggccttccgcggaaaattcgtaataattgaatagagcgaaactcgttcttgcgaaaaaagcgtcagagggagagtcgaccaacgggagactgctccctctctctttttctaatgtaggttgggtaatatattatagagcagcatgaatatttgtgccttaaaatgttctatatatggaacattttttgtatctttgcaatgcaataacaaggtatggaattgaaagcaagattcaaagtgataatgtcaagcgaggcagatgcctttcttgatactttgtgccaagacattaaagacaagattgtttataatgtagataaggttgccaatggatatatggataaagacctttttaaaaaattggatggtacggatatttgggagttccgcactctttataaaggtattcaatatcgtttgttggctttttgggatactgatgcggaaacattagttattgctacgcatggatttgtcaaaaagacacaaaagaccccaagtaaagagattaacaaagcggaagctattagaaaattgtatttcaactcaaaaaaatagtgatatggaaacgattaaattttatacccttgatgaagttaaggataagcacattgggaaagtcgggacaccacatagggataaatatgaggctgaattgcagtcgttccttatcggtgaggctattaagaaagcccggaaatcccaaaatatgacacaagaggaactagcccagaagattggtgttcagcgtgcacaggtgtcgaaaatagaaagtggtaggaatctgacactttcgactgttgcgcgtgtattcagagcaatggggatggaggcctctttaagtattgcaggttttggaagtataactctttaaaacatagaaggtggacaatcccacgcgccgttgtgttttgcggtctggcaacaactcgaatgcgaacagcggtctcgcttatgcgaacgcgaacaatgcatcttcgaactcgaacacgaactacggggcgcggctgaaattctgttggttaaactaatcggagactctatataaggtacgagattaccaccgatattctccgagggattagaacctcggcaacagcataataatataatatatatattttatggaaagccggaacataacattaaccatatgtggggagtggcttgacttctccccacgagaccggaaggcggtctgtaaaattgatgatttatttaaactgaccggaaatatacctctggtcagttatccgttatataaccttataccggaaattatatcagacgaaaatttggaacgctcatttaagcgtgtcatggcgaatctacgaaatgcagatgctcgaaatgggaacagggctatgccgaaaactatcatagacggtatcgaatgttctccaagaatgattcgttatgtgacaaataaaggaaaaatatttgaaacgttgaaaaaccaaattggtaatggtacattccgtatcaagaaccttaaatcatttctcactgaagatggcccgaaagtaagaacagtacaagctccttcggtcatagaacgcattgggagtaatgctattatggaaccgttggaaaatcgactttcttctttattgataaaaactaccgctgcttccatacaggggcgtggcccgcatgggttgtttcatcagatacaagctgcaatggcagaaaatcctaatctcaaatattactatcaaagcgactacaaaggatattatgacagtattaatcacgaaactttaatttctattattaaaagatatgtaggcgatcctcttcttttgcccattcttgaaaattttgtgaaggcactctatcctgatggagaatgtggtatcagtaagggattgcgatcgtctcaattcctcggtaatctttatcacaatgatattgaccaccgtatgattgatgtgcatggagcaagatattactttcgattctgcgatgacatttttattcttggagaaagtaaacgcgagttgtggaggttacgtgactgcttgcacatcgaagcagataagatggggcttacgataaaatcaagtgagagagttgcccctatatctgctggtatggatgctcttgggtatgtaaattatggtagccatactctgttaaggaaacggataaaagtaaatgctgctagaaaactgtctaagttgaaatcccgaaagcgtagacaacaaataattggatcatttaagggtatggcttgccatgccgattgcaagcatctattttatatacttacaaaaaagaatatgaagaaattttcagaaatgggtgtaacatacaccccagctgacggaaagaaacgctttccaggtaaagtaacacgattgagtgatatagtaaacattcctattgaaatacatgattttgaaactggtatagacactaaggaaggtgagaacagatatttggtatcatttcgtaatcctgctaaacaagaatggggaaagttctttacggcttcagcggaaatgaagggaattttagatcaagtcagtgacattgaggatggttttccgtttgagacaataattaaaggtgaagtttttgacggaggtaaacgaaaatataatttcacctaacaggtaaaagataacatacgaatccgcatctcattcgctacttttgttgaaaatcaaaattcataaagatggaaaagatttacggcacaaagcagcggcaggatgggcttatacatacaggccgaaccaaatggatattattttatggctttggaaaggatgatgaggcaagtgaaagaggttgggagtaccgacatacatttgaccacagtccaacactttccgaggttaaggaacttattatctctactataaatactgccacgcaggagaagatcgtgaacggctttatatggaatgaaaagccgatatacctatctgctgaaaatcaattgaattttgctgctatagaacgtaacaaaaatattccatatccacttaccctaaaaatcaatgaacaggaagatggtactcccatctactataccttcgataatgtagatgaatttatctcattctcccaggcaatgagcctgtatgtgatagaaactgttcaaaatggttggaaagaaaaagacagtgtagattggacagtgtttaatataaaatagacaagaatgaagaaaaaattgattgaatggcttgcgcaaagcaacaggtggaaacatcttgttgggggatttggtatcggtatttgtgcgtttgattggttttctgcaacctatgcaggtgtacttactgcaggtgctttggagtataaagacaaggcatatggtggcaattgggactggatagatttcggcttaacagtggtcggaacgtgtgtaggacaattagtgagaactatcgtatgacggaagtgcaacatgtaacggaggtggctaaaggcattagtgactatggcatgatggctgtgagtgctgcattttttcttttgctttcagcagctatgatgatagcactattcaaatggtttaagagtatgataaaccgccttctggaacaacaggagtgtttgaatcaattgcttgatacagtacaagacaatgtgagtttgcaacgaaacttaatggaaagacttcaacctgaaaccttactgcgtatccggaatttgacgggtttcgcttttgaccttagtatcgaacaggtttgtaggttgataaagcgggttcgaatagagaatcacatagctgatcgtgaagcaactgtaaacaaaatacggaaatcacttcaagtaatccatgatgatcgaaagagccgctttgacccttttatatatcatggaaaacctctgtcggaatattgtaatgagaattgggtggaagatgtggtgagtgtagttgaaagtgaaatctataatgaggatggagaaaataatgcacgtgcctataccaatgtgaaacttgcatacgacaatataaaaacggacttttatcaacgcttaaatagttaattatgaaaatattaatagataatggacacggggaaaatacaccgggcaaacgttctcctgatgggaaattacgagaatacctttatgcacgcgagattgcagaatctgtggaacgagccttgcgtgcgaaaggatatgatgtagagcgtattgtgcatgagacagtagatgtgccattggcagaacgagcaagacgtgtgaatgagatttgtgcacggtatggggcaacaaatgtattgcttgtttctattcattgcaatgctgcgggaaatggcgaatggatgagtgcaagaggttggtcggcatatacttcaaaaggtaaaacaaaatcggatgaattggccactatgttatacgaggaagccgaacagaattttgccggacaaaaaatccgtagggataattcggatggagatccagattgggaagagaacttctacattttggtgaaaaccaaatgtccggctgttcttacggaaaatttcttccaagacaataaggaagatgttgattacctatattccgataaggggaagcaagccatcattaaaacgcatgtagatgcaataatcaaatacgtcaccaagtatgggaaaacttaagaatattgcagtagtgttgtttatgattgtatttcttgcttcgttgtttatgaatgtagtacattttgcaagtaggcaacagaaaacaagagatacaacaagaacaacctatgttgatacaataccattttataagcccattcctaaagacagctttgttattcgatatgttactgaacgtcttcctacagtctcgaaattgccggaaaacgtacaaaaattgcctgaaagcgtatcagaatttccgaaaagcgtgaaaaatttccatgaatctgtatcagaggatagtgtagatgtgattgttcctattaccaaaaaggtatacaaggatagtttatatacggcatacgtaagcggatataacccgaaacttgacagcttggtattacattcgcaacatgaagtggtaaccattaacgactgctatcctaggtcgaggaagaaacgttggagtgttggtgttcaaattggatatggaatagcattaagaggggtgccggaatttacaccatatattggagttggtgtatcatgtaatctattcaatttttaattatgacagatattgctttaaccgttaataaagaaagtgtatatgaagaagtggcacagaccacagcttataccggggctaagatggacaacgaactcgcatacaaccgtattttcacaacggatgaggataagagtatgctagagcgtttttggaatgaaagcaaaaacactgcttgtaatagcttgaaaaaaatacttcttaacgaagtcgaaagagaggggatatatcagctttcgttggggttatcaagttcgtttgatgaagctttaacagaaagtatggaacgtagtctgttctcgttttttgttatgaatattacggcaaagtggtacacatttaccaataaagaagaagcaaccggatatgcaacggaagcggctacctatatggaggacgtcatgcgtaaggcattttttaaaaaacgtcctatacgtcctacgtacaattgaattatttttaatctttatttattatggcagaaaacaagaaaatattgacagtgacccaacaggttaaagagcttgtttatgatattcagaacaaggcatacttgaccgggcaggcgcgtgaagcagagggtaaaaagaattacgaagctgcctctaatatgcaagcgagtgatgatgaggaaaacagttaccaaatccgtcgttcattggcaaatgcattttcatctttgaagagtctgcttggagagtatctttcagaagacaaaagtacaagcaacaatctgatcgcaaaagaaattgatgataatggtgtactagaacttgcattcgagttgccgagtaactacaacaactcttcggctgatgcgttgggcaatggtattcatgcctaccttgtagatatggctttgggagattggtttgccattactaacccggaagatgcagcttcatacgtacagcattcggcgataagtttagagaatgtaaagcgtgcgctttataaacgtagccgacctgaaagaccgacttattcttaatgtattctcatgggatattgttgtaagaaactccagcagacaaaaacagtaacgctgacattcaaacgttcagagttactctatgacgtagagaactactcctttgtggaaggtgatattatggaaacggagaatgaacatgcccggcatcaggtgtttgacattggacaaagtggtaatgtgaaccgggttacacgtgtactcaatcttacccatgcagaatgtgtggaaatgctatatccatataccaaagaggaaatctcggacgaacaggaagctcttgatgatattcttgtagctcccgaagaatatcatattgtactcactttaccggaagatttttctttatctacggtgaagctactaaaacatctgatacacgagtatcttatctgtaaggtacttgcagattggatgagtataacgaatccaagtagtaaggctaattgggaggagaagataatgagtatcagagctaagatacagacatcgctaatgtcgagaaaaggcaaaataaaacgaaagttgaaacctttctgataaaaggaagagccggagtgcatcacgcattccggctcttttgctaacaatctttcttaaccttaatatgaaaaaactaacctatgtaagttatcttggtttattaagcatacggggggtgaattggacggtaaaccccaacaaactttcagatttgtctagtttgcatattagtacaagtcggaatgctttgtatggtgtgccatggaaacctcgcatatatttatcggtactactccatactgcatgccagttgaataaatcatttgagccatacagaacttgtgagacatggctactcttgaaatatccgcgttgtatgatggtgtctattgttttgaacatgtttggatcatctattttgaacggacgagtgacagccaatgcagtaataggttctattgtgttatcaggctgtgagaaattaacgagatcattatctgaagtcatagcgagtgcatcaggataggagtttaaaccactcatgatgttactatgcatcattccccattgcttactatccattgaatataagtaggcataggtacatgatgggttgtgaatgatgatacgttggtgtatatagtcgtaaatcatcctacatgtttttagaaattcgcggaaagttagaaattgaaactctgttgaattaaatcttgtattattaaccaatttattcaaatggggtaaagaattgatagagaaagccaattcactgtccaaaatatccgaaatacattggcttgtagaaccgctaataagcataataccacggtcagtcgcaaatagtacagcattatcaatctgggttatactatcggaattaatacacacatcacgtgtgataggctggcgggcagagtaggaaccggtagaagaaacctcgagggcccaaattccatcagtagagaaacagtaaagaggaaattgaccaaattggccttgtgataaagcctttgcggctgaactgagtccaatgattgtacctgttccaacagtgcagactccgagagcgggaaatgaaaaaggatcgtttacatcagaagtatatattttatttggatatgggattccgatttctgtatcagtaatgaggctcatatcgggggtactagagaaactcgtgttgatacttccgtatactccgttaagtgtttcatgtttatgtaatttgctatatgaataggattttactccattgttatctatacgctcaataataagctcttttgcattgatgttgggataaaagaagtatgaatcaacgatattcattggtataccggaaagaaactgtaccataacttttcgtttctcggcttcaatgaagatgtatgctttataagaatatgttttctcaacggcttttttagtttcgttatcatactctccattagcatattgaaaacaagattcaagtgggaatgtcggagggataatagttactccggtcagatttagacgtgcgttgtatggaaatgcatgttttgcgacaattgttcccattaaattgctgtcaccctccattacttctttagcctcaagtgaattgagagcaccattttcaatagaaacaatgttctcacccgattgtattttttttacgtcaatggaagagataaggtagaaaggtaatgaagagtcatcatctacaagtgatttacctgacattccaaagaaaagttgattggaattgattgattcacttgcattatgacatcgatatattaatttaccgttgatattctcattaccggagttagcgcaataacttaaaaatgcggacgaaccacccattggtcccaaataggcatatggggagattgatttgcacatactgtcctgatcaacagtatagagtgggggagtgataaatatatcaatactcttaaccaattccccccattcggctacagatcctttcacttcatcgaaatttgttatctcgtaatataattttgatgcaacatgcgatacaaccatattgaatttggtgtatagaccattgttaacttcataacctgtataatgtatgagataaggtatgccatatgatgggtagacttttactggagatgaaatgtagttgagggttccgtcatacatacggtaggcatatcttatcatgaatgggtattggaataatcctgctgttttggcatcggcggtatatttattggtaaatgccaacacagtatctcttacagcttggctggcttctattgagagaataagtgaattaagaataatagacggagtaaatccggggaaacttgcagataacatatccgagtttcccatagatgctcttagtcggaaagagagcgatggaaataccgggttacttcccatgagtacatatgttcctgacttgtagagggcataaattatgccctcagaagtgagtatgattaatgtgtttccaagtgatgttacctgatagagttctccagaaatagatactatatcttcgggctgcttatcagtgtcgttagaggataaccattgtaaggcggcggattctgtatcgtaaattatgtaatgtttatataccgagatgttgtgtatgtatatcacttttttcccttgtgggagagtgaataaacattgaggcttttgaatgccttttaatactccatcttcaggaataagattcattgcaactgacaagtcaccatctgcacattcgtaatctgatggattggcagaatatccattgtacttaatctcttttatcatattacaaaaggtatttagtgataattggtaatagtttaccgtattcgttttctgttggttctcctacacataatcttgctttagctgttgctttacattcttggagaattgctgtacaaagtctgcttgatgaagttctgaaatgatttcctgccttattcgttgggaataccatcgcttcatgcctcccgtttggtgaacgaagtctaacgtaaaggtaaaattcatcttggtcaatcattatgtccaaaacatctccgcgtgagagctggagatgttttgcgacgcgagcactaatatctatccttcctgatgcgtaaaaggtgatatcagcttttcgggtgtttcctaatatactttgcatttggcttgtcgaatttataataagtttttccttgtggagttttctgaattgatacggacaattttactcgacagttatcggatagtccatattcataaaggatgcggccgactgacggacagagcgtttcaaatcctatacatttatacttgtcgttgtattgaatatcgcacatttgggttgcttgttcaataactggattgattatgaatccgaatgtatcgtctccagaaatatggaaaacgaatacacgcgctgcatcactcttcctggcattattcttgatatgcaagaacaagtgtttggaaagcgttatagagttgtcggcagggtcggcaatcacataatacagaagtgattgccaccataattttaacttactgataatcatagtacgaaagtatgatgaatgattagcttttgtagtttaactttttactgacgcattgagatgtactcgacgagaacgaaaggtaactgtttcgacaaaagtaaacgataaggttgtttcgatttccaatcgatgccggttagcggcttcttttgttgcaaaaatgtaagaacagatttcttgtttggttgtacctttggtagctacgatattggcataatatttgcgtccgaagaggaacgcaatgatttcttttaatactgttgaattcataatctattggttttaatctgtgaataaattcttttgttccggttgtttgggaggagggatgatactattaacacgttcaatctcccggtcaatctcggcttcgagtgctttgcaaattcgtaaattagcttgagtacgacatttgaaatattctttttgtgctttgcgcatctggacaactttggtaaagagtgtttttgcatccattatttcttatatttgtattgttctttaaacatcgaatccgcttcctgaaattgttttgtaaagcggttttctttatattctctcttaaaagtcacatatgggactttctttgtgctacatcctcctgttagagcaagaataacacatactagtagtatttttttcatttctgtcttgttatattccactcactttccataattacgtgttcacacttattgcacctatgcaaataagttggaaaaggggctgttgtataatcttcaactgctatctctatactaccacattccggacactcaatacttacttctttgataccgggatagtcccagaaagatagtttcccttttacattttcgataggttcttcataaataataggattagctaacacccagttataaacttttttttcggcccagatagaagaatgattctgtacacaatccactatctcaatgctaccgataatggagcctgtacaaaaactaaaatctttccactctttgttttccggtaatgccaataactgctcattggtaagtattgaatcatagaaattatcgtaattcaaaggtttaccgcttgaatgaatcagtaccctctgtcctaagtatttcttaggacacggccaagttcggttctcgatgtttttaataccgtggactattaaggatgcccacggttgttttattgttattgctttcataattagtcttagttttgatattggttaaaacagattcttacataacgatagaatcgtatgtagccgaacgaataagagggacattctgtattatcggatatgtcaatttgtacattataacctttcctccgcaaaaaacgggcagctatctcatcaacagtatatcgctttttgtgaatgtcccagcaactggatttccatactgttttaggactacctttttttagggctttcttaaaggttttaatggcttgtatgatttcttttttgttcatatttattttgtcctataatctttaataaattcccacttttcgttatagtaagcagtttcccaagttgggtgaaaatgaactatcttattataattaactaactttccttttagaccaccagaggatactccgataactttcacggcgtttttgtttacaatcgcattcataccgatttgtaggaatggcatactgtattgttgctttatctgttcaaaagcatatttatcagcttcattcattttaattcatgttttgaggattattatttttcttcattcctatttttcaactccatttgttcaattaagaactttctaaaattattcttatattgactatgaatgattttatactgctttgatagattaggcagttgcttataccccttactatgtaagaacttggctacaagttcaaccttttcatggttatcaaagcctctgtccttgcacatatttgagatacatatattcgccttgcttgttggcttctttataataggtagagcgttgcgtctgccataagcgtgggttcttggatagccaactccttcacccaagtattcgcctgttatgtaatcaaattccccatttattaaactttctgctatttctcccattatatttctccttttttgatttttattgattattattacccatatcataggaattgtctccctctatttcaattccatcttcacaagctacattctcacagaatgcctctttttgatggaattcacaccatccgttaccgaatgaatcttcattggtgaatagcttgcattcgccacatacttgtttatcatccatataaatgttactttctgttttgatttatttgttatgtaattgtaaaagtcctctgaatgtaatacgcctgtgtatcatatcttgtcgtaaacggtgtattctttcatctgaatagtctgcaaatatctgatttctttgtttctcctgtagtatgcagtacaaggaatcagctctaataaaattatctttccgcaggtacttttcagcacaatgaggacacatacaatcaagcgtgatattctctttgttaagtcgtggatgaagaatagaataagctttttcaatatcaatgtctgatactttttgtattgcgtcatcaaagaaagcatcaaagccggtcagacaattcccgtagtaaaatggacgtttcagaactttgtaaatgccgggtgattttcctacctctttagaatttgtctttgatatgaaaaaataatctgtcatttcgtcaatctcccaagattcttcgcaaatagggcatgtagtccgatattcttcatcatagcactcttcacagagaacttctttacgttcaactgatacatcgggaaaatcatcgagttcaaatatggactttccgcaatggtcgcattcgcaatcatgctctatgataagctgtatctgtgcatcgtcaaacctatgcggacttgaattgtattcagtcttggcatgattcactattttatcttttaatttgctcatatttcctttgttatgaggggttatacaattcatatccattatcccaaagactatcactgcgaaaattgaagaaatcttccaaagagatacgtacaccatcttctaaaagaagaaatccgttttcaatagtcatccattcgtcagaggaaaagaaacggtgcgtaaccttcttaccctctttcattgcttgtatagcttcttctttgctcattacttatttatttttaattattcgacttgttcctcaccttcacgtattagggtaaaaggtagtttggtaccacaattcacacaataagctgttttactcttgtttaaggaaactccatcggaatattccccaccggaatatgtaccgtcagaattatgcacactcgtgtaactcattctaaacagatcactatactgataaccgtaaaaaccattgcaataagggcaaggaagcggttgtgcttcagttacttttatggagatttttttgctcatttctactttgttttactataattctatgctgctacttttctcaattcgcgtagtttcttgctgactgcttcacaaagaactcgcgccattgtaacctctacggcatttcctatgaatttcttttggtcggcttgtgttccgattaacacatagttttctggaaaccccataatacgctttagctctggtatgcgtagcatccgcattttaatatcaactatcccgtataagcccatgaactcttttatttttttggtcatagggctgtcggtatcataaatctcgattgccacacgtccagtttcggttgcgaccaaataaggcggcattttatccatacgtgctatgagagtgaagcatgggttatcaatggaaccacctgcactattaaattgagggttcattaggtagtgccactttctatttgcagtgattgtttgtgcgggatcttctatgctactaccaacgttggagaagtttgtattcataatccacggcttgcagctaacaagattgtatttaggattggcggtaatacatccaagcggcttttctgtagatgaaggtttgctgtttccatattgctggtctatgaaatatggagaaacgagagagaaccgatcctttgttgttacggttgcagacggttcgtttattgagcggttaaatccgttaccgtaatgagctgatacaaacgcatgatgatctttgcatgtaattgttccggctggttcattaatagaaacattcttgctttcggggtgtccactgaactgttttgaaagaaagcatacctgtgcaactcccagtctgttttgcgtagctactaccgggcatggttcatcaatcccaggagcattgtattttccagtccgactcatggaattatatttgataagaaaagcatctttgcctccggctacaaattttatcaggccggcataaatacgttccattgtcttttcagcaagtggtttctcacgaaaaatacttgttccttcatcggaaaaatccaatatctctttaaccgggcgccacttttccaaatgaccaaacatatcttgtttaccgtttttgcagtgagtgggttgcggaaatactatcggtaatccatttttggcaaatataccaaagaagcgttttcgagtagtatatgcaccatagtcggcagcattgagaatgcggaaatcaaagttatagccatactttcttacgttgcgtacccatctttgatatagcctacctttatccatgctgataggctttccgttttcgtccatatcaccccatgacataaactcctcaacattttcaatctggatataatctggattaatagcttcaatgtaacgaaaaagatgttctgccagtgtccgactgtcagcatcacgtggctgtccaccttttgctttgctaaaattagtacactccaaagaagcccaaagaactaagtgagcatctggatatagttgtttcattcgttgtacgtgtgctactagagctgatagttccagtgtgcgtatatcttcagtgaaatgcattgcctccgggtgattggctgcatggctagcgatcgcattcgtatcgtgatttacgcaagcgataatctttgcgcactgttcaccatttattctcgctgattctactccggtggacgttcctcctgcaccacagaatagatcgacgtatagtagatttatattattcattttagattttgtttattaatactcatttgacattctctcaactttttgagcaggaatctgccaggctggttgatgccgccttttttaatttcggcaatcagctttttacattcttcgaatagtgtcgggtcttggatatataggcgaactgaatctgcatcggattttgtcaggttcattagcagaaaaacatacacaaagtagttttcatgagacatcacccttatttgtccttcacgctccattctctgtagattttggatgattatatagaagtcacacattgaggggttgtctagccattgtttgatgagtcccgtgccgatagatgattctttaccgttttcggcaaggcgcatagcttcccatacgtcattttctgttatacccggtttaccacgcaattctgccttaatatcaaaatatttttcagaaaaaggagacgaagttattcttcctcctctgtccgacgaaacgaccccgttagggggagtttgaggaggtattttctgttcttttatttccttttcttttatttgtgtactttctgcggagtttttgggcttttcttcggaagaaatgcgtttatcttcggaagaaataaggttaaactctgaaaattcacactttcttctgcaatcatcacatattcgtttatagcgttcttgtattccgattgaagtgagaactttttccttatcaaagagttctttagaaaacaaccctagtgccaggcaacatttgacgacctcctgtatatacgcttcttcaaaaccggtttgttccgataatatgaagggcaactcttcgtcccacaacatgtaatacccattcttatagataagacaaagcaggagagcatatacagtgacagccttgccacgctggtacttgatcagtttccttatttttatgtcctgaaaaaagtcaacatcaaaagggaaatagtcgagccctttttttacatttcgtcccataattctgcattttttagaaactcatccacctcacgaatgaaatcatctagcgaatggcatacaacatatttgtattctctgttttcacagatcatcttttgccattgtttttgcgatggggattgatagccacctttctttttcatttcaatgagtagcgcaccgtaatcacgattgcttttcaataggatcaggtcggatacaccggctattacaccctcggctttaagttttgatgctgttacagcatcacgtctaccaccatttggtacggcgaatagtcgacctttcaacttcggatacctcaaattgaagtattttacacaagcgcattgtatgcggtgttcttcatcgttatgtttttgcttctttttttgttttctttcctttgagagcatctcttccaatgtcatggctgttttcatttttaggtgtaacaatggtgtcctttcctgttttgtcgactacgactttctttcctccaactgttattgttgtcttacaaccttcaggaagtgattggatgaaattgcgtacaataggggagttggcattttcgctgatggtatctgttatggattcttcggcagaatacgggtaaacacccatgatagcggtttcagcaacagatgcaatttgataatctgccatggttcctttcattccttcatccagctttttcactgcatcacgcaagtcggcagcttgtaccaatacttgagtggaagtctttttttccgcaccgcttttatcatccagcgtgatgaaaataagtttgcatttgaaccagcggtcggcactttcttcgtcactggggaaaagttcgctatagttagcacgtttaatgtctgatatagtaaattctccagagataaatggggtcatttcttcgatgatccgtgcttcggcttctgtaaagctaagtgcatcgacaagataaggttctgtaactttcttgttcattccattttccattactctttcgtaacggattttacattcaaaccatgtgtgcatcataaattcattcgagctttaagttgtttactaatgatgagcttggcagagcgttgagctggaataacaactgttgttcccttgctaatattccgtgctttctttcttttggaggtgtgtgccttaattgtggcaaaaccacggatataaacactctcacctctacaaagagaattttcaatagcatcaaaaacgcaatctacggcttgaatagcttgtgaacgactaatagtcgtattgttgatgacgtgttcaacgatttcaattttcttcattgttgtatttttattaaaatggtaaatcacttccgttaggtctacaatcctcaattttgtactgagtatcttcaattgattttattgtacataaaacgtatgctttcttcttaagaagagtagcaagtcttttcgcttcattttcggcgctttccaaattctcatgtttgtaggtaggagtggcgcatccttctacaaataccatataaaattcatccatagctctatttagttatttataaatagcccgcatttcccgttaatttggttttcctctgctactgtttcgaccttgtaactcgtactgccaacgcaagcaagactaacgaggatagatggtatcttaatgtttgtcgatgttggccatctgttccattccaaacttactgattactacaaggtgtttacgggctattttattttacttctattctaattgttttaaataatatttgcacttgaatccttttcgtggtgaaaagtcggcaaaatcacaagatttaaatatttgatgtttgttagcccactgtgcaatatccttttcgtataatgttggtttgcgatcattattaaagtctcggtatggttgtacaaaaggtgagattcccaactccttaagtcggtttaaccgatatatatcttgttcaattgttgagttaaagccgactagaacatagcaagacaaattacgaggtttgatatatttagtcacttcttttagcttttcagtaaggtcaatatccggtaaatcccaagcaatgtggattcttcttttcaatttcaacttactcaagtaaaatgcttgctcctcattcatgatcctgacatcaacaccatggaaattaaccatttgtccagcttttataagatagtcaatagcttctttccatctcgggtttgcaaagaagttgttgtctaatacttctatccattctcccttgggattcaggtctacagggtggacggaccggatgtagccctctttttcccgaaccagacaaaatgggcatttccggatacagcctcttgaaaagaactgaatagaaaaatgatattgtggataaatggaataatccatgagtgtgctacaagatatttcaaatggaagcttcttatgaatatcataaccggttcctcctttttcgataatatcagcttgtaatgtcatataattaaagtctggagtgaaagtaaacactttgctcgctagaactttatcatatctgttgaaaggagtagcccattctacttgatcgccttttgccttatgatatgcagaggcacgcataagagcgaagtttggaaagttatgaccgtcaacgtctattaatccaatgttcattacctattgttttaaattattattcacccagcatcgtattatacatcgcacgcttcaaatccgggcgccaggcaagacaagactcttgcggatcgcagaagatgtcaatcagacattcggcggcagtaacaacgcgctgccagttgctgcatccgcataatctcattctgcgtttaataaactcgtataagacaagacggttgtccacttcatcctcatcacagtattcttcctcggctatttctttacggatggcaagaagttccagtttatcctcgttgtcatcatcccactctgtccagctttcctcattactccacctattattgaagagttcctccatcggagaaagcagattgtatactttctcaaagtcattcttggatgcttttgctattgttatttgatgtgttgccatattatttttattcttgatttgaatcggtagatagaagtaagacgatagctgcaatggcaaaagtcattcctaagatggcatacgtatatgacttagatgatttggattctaaggcaaaatgaaagttcaaagcaaaaaggatgacatttaaaaccacaaatattatatcgaaatagattctcatattactttatttactggttactactaattttttattcagtttttttattagttgtcttattacccatgcgcgacatacattacgttgtccggggtgattgtcatacattcttgcagcgtcatcaagatatttgataattttctgcatatctgttttgcatacttccattatcctgatgctgttaagaatgatttgaccaattcattgaaatacatttcatcggtcggaatatcatcgtcagagttcataatctcggatgcgatggatttcttacggtgaataagagagtatatcgtatggtcgattgtaccacgaccaagcagataataacaggttacattgtccttttgccctatacggtgtgcacggtcttcacattgacagcaatctgcatatgtccatgcaagttcaatgaaggctacatttgaggaagctgtgagtgtgagaccaacgccggctgctttaatggaacagatgatgagctgcacatttgggttgttttggaaagcatccacagaagcctgtttgtttattgcgctatcgcgccctgtaaccgtgacggctttcggaaataccctttgtagttcatccacaatctcatgaagcgagcagaacacaatcagttttttgccactgtcaaggaatgtcttgataaagtctacagcttgtgctattttacctttggtggccaaggaacgaagcgtcatgaatctcacaagtgcttccatacgcatcttgcggcgtatttcccaatctgtacattctgtatattcctgtaggtatgtagcgagatcggaagctgcaagattatattcggcactgttggatatatcgacatataggtctactcgtgttttatcaggtagctggggaagtacctttgctttttcacggcgtatcatgcaagtatcatagagttgccgagatagttcggaaagtggtacagccggttctgcatccttgtcttttgggtcagtgcaatagtcagctatgaattttccgcgaccgccaaagtcgtttaatctgttcatgatagaaagttgtgctatcaaatcctccggacggttgacaacgggggtacctgacaggagtattatccattccttgccaacagacaaacctttggtaaagattgtttgctgtgcagacgggtctttcacacgatggctttcgtcgatgatgattgacttgaacatttgtatttgaggacagaatacaacatctttaagacggaacagcttactttccgctttgatgtcccaaacaaaatatttgcgcaaactttcgtaatttaccactgctacctgatgcactcccatagataacaagtaattccatgtcgtacgtacagcattgtcaagaacgaccgctgatttatccgtgaatttctcgaactcgcgttgccagttgattttgagcgaggacgggcagataacaagacaaggatatgcattggctgtatcaacaatgccgatactttgcaatgtctttcctaatcccggttcgtcaccgataataagacggcggtgttccagtccataaactataccttcacgttggtagtcgtatggttcaacgcgcagatgatgtttgagtctgttcattgtatttccatccattaagttcataaacacgtttctttgctttctcacggtcgtagaagattggctcgttaagtaccggagaggctgactgaaaattatctgttacctctgtatagcggtatatacggaatcctcgtccgtgtggagagtaatgatattgtcctacctgtggtttcatttgaattcttctatttctgtgattaaatcatctttgtcaattcctttgatgtacttattgagaacaaggtcaatgcattggttatagaacctctcaaattcgtgttgttccatggcggcaaacgatatactgagatactctatttcatgttcaccatattcgttgagagtgttagtgaagtagccaaggtcacgtttgaatctgcgaagcatatcctgttcattatgtatatgccatttttcgactaatggtaggggcaaattgtcgaaagtaaggcgtaccaaagcgaaaaacttcttgtggtgctcataattgcggggattgctaaccttacacttgactacattaccaatcttcaagtgtttctttagttcgaggtctgtattatacagaggaactaatccatattgagttactttgcaatatatatccattgttaattgtcttgtggagttaaacaccagtactggaaagccaattcttcatatttctcgcgtccacggttgtagaccttatcatcccgattgatgaacttcttgaatactttgcagttctttttgctgatagcataaatgaaatcacggttggaacctgcaatgtccatataccaagcacgactcctgtcccaatcgaagaagtcaatcgcttcttcaaactgttgctgtgttgaggcaaatgtggttttaagatcaccgccgaaaagaccgagccaccaatcccacttacatcgtgtatcaagtgaaaaggggaaaccacaataagtaaattgttgttgtgtgtttaccatgaaacgctgtgtttcggcataaccaagcactttaaaaaggaactcatcgcggcgtgcttccatgcgaagtgccttctgcatttcttgtgcatgtcggaactcatcttcggtatattgttcatcatctactgttaggcggtagtagtctactcgtgctggttcggtaataattgcatctaccagcgagccgaaacgaaatgcagcttctttatcaccgaattgcatccgaggatggagaatgttttttagttcagtgaggtcagagttactaacctcactacgattgtaatatgtatcgggattgtgactcatggttactttgctttcacatcgtcaatatattgtacactctcattttcaatatagacactatccttgctagccagtttttcacagaacgtaatttgtttcttgaataacttactcaactcttcaaccgaaagtgtgcacccttctttactccaccacattgagagtattggcatgataccttcagggttaagtaactctatcttttgagtgacttttactttgggctgataattctgcatagaagcctgttcagaaaataatccgttcatttcagcttgctggcgtgccatttccgccttttgcttttcttcctcttctttgcgtttgcgttctgcctctcgctcttcggcttccttgcgttggcgttcttccatttcagctttgacacgtgcagcttcggccgcatcagcttgtgccatgcgttcgaggtttgctttctttgagggcagacggtcaagaatgaaatccttgttgtcttggatttctgcagtgtattgttcggtaaattgcttaccaaggcgttcctttgtgtcagtttcaaattgtcgaagctcgtctaccgaaatattggcaggtatacggatgagagtatgaagattatgtaaccagtcagcaggaagagaaaccgaaaagttctttacctcactgtacactgtgttatagttctcgagcgtaacactgttatcctttgtagtgagccaattgatggattgattgagatatgtttggaattgtgccttaaaatccccttcaatgtcttgtctcaattttatacgggcttgttccgcttgttgacgtttgtactcttcctgacggcgtttttcttcttcggcacgtttctttgctgcatattggttacggtattgttggagtttataggggatagtatcaactttggttgggtcaatagcattctctattaccgtaaactctcgacggatgtcatcaaaaagttttgtgacaggcgaacgtttctcgttcattttcctgactgttttacgtgctttttcaatgaaaagagctgcttctttgtcaatttcgtccgtcatcccaccattagctgtaatagtattgagtatggattgtccggcactgatacatctttcacatgacagtttattgtcattatatgattgtggagcagcagacactatggtttgtatattttcctgcttgatgattgctaattctgaagacatatgtacaatgtattaaggttagaaagtatcatcgttatctccttgacttgctgggtcaatagttacccctgccgacatgtcaggttgaggcgcgaaatgctgctcttcttgcttttcctgtggttcgggttgtgtggtatcgattccactgtaaggatcgaaacctccttgcggggtttcaatgatgtcggattccatgacggaacctttaccgatattgattttaggataagtcttgaaagcgtgtttgatgcatttggcaatgaggaagccggtatcaatctgcccattgatattgtagagtgcattgcttttcactacagtttctccggtgcggcggtctttataggaattttgtttctctgaataaccttgtaaccgtttccagtcggtttctgtcataacagaatagtcaattgacccatctgcacgtgtgattttgacaaagcaagcaacaatacggtcgcttttgcgaggaaatgcagacatataattgacaatcttcactccgttcttctctccatattcaaaactatctccgtcatagacgataactggattgtcggcatggcgtatttgtccaacttttgcacgcagtgccagctctccatatccggagatagcgaggctgcatactttctcccaaacttctttgccgtttgaatcaactcctactttgcagttacgggtaagaagataacacagtgcttgcgcaccaggagccaatgtgatacctttgacagcaaggtcaataaacgcatagaagatagatgttccggagcataagcgcaactcatctttgtcgcgtaactgctggttgaagtaaatagcttcacgttcatagacgttttctcctccttctttccaaatggaattatacacgctgataaactggctacgtacacgttcattgcgtattacgtcaattgctttcatttgttgcaattctttggccaatgaaatagcattgctcataattaataatttaaaaggtttataatacagtttgcttttgtgacccgaagcagatttgaactactactttcagttgatgtgctaccattacactatcaggtctgattgtcacttgaaataatcttgtttcttctgttgaagagcgcgtaactctactgtgcgatattcaactttgcccggacgcttacagggatttattttaccctgtttgcgccatctatccacattaccgcgaccgaacattgcgtatgcttgtcgctgactaaccatttcggggtcgttgcgtgtgtcagcaagcattcgaaccactgatgtagcaacatcgtggatgaatgtgtcataagtgacagatttatctgtgaaatcaagtgtgaacatagagtgttactttcttttattattgtgacaatgcatcgtaatattgtttattggccatatattcatcggctatttggcggtcggtgcatccattaccgagtttcagatatatagcctcgtatgcctcttgtggcatagcataaactatttgttctgtacgatcagtggtacctgctataccaagtaagcagaagaacataatgaagcctgctacaaaaacgacgatttgtttagtgactctgttgaaattcatatgatatcattttaatcgggttactgttatggtgcgtttttcgcgatcagtctctgtttgatacttgcggtcgagaattaacccgaggtcagacgcctgggcacgcacactcttggttttcgctatggggaaagtaatctctccgcctactttcaaatccgttaaagctggacgtacttttacttgattttctgccattttctttgaggtttatggtttattgtttaactttatgctgcaaagataatcaatctacttgattataagagtaaatatactgatttaacaagtgaattaactattattaaaacatggagaccataaacgacaggctgcaatggattgtcaatgaaaaatttgatggtaataaagctgcttttgcaaaagccattggaatcgtgccaacaagtatatctaattatttaggaaagcaaagagcgtctaaaccttccgttgatatgattgctaaaatcgtcaatgtacttaatgtggacgctcgttggcttctcacaggggaagagacagcaaaagttgagcaagttttaactcatggtgatttctcaccggcttcaatccatggggatgcggtgaatggcaacatggatattgctgttttgcaagaaaaagtgaaacatttagaggaacttcttgcagaaaaagaaagattgataagtgttttgatggaacggaaatgagaaagggtttaagctgtataggtctttggttgtgtctgcttttaattatagggtgttcaaactctgatagccaacctgagaatgttgaggtatatttggaagctaataccgaccgtgttttattaaaggaagaaggtggtacagcttacataaatattgcttccaatacgaggtggacgatactagttgaaaatgatgaaataccggttattgatttggatgttactccacttgcaggtgacggagatggtactattaaaataacttatggtcgtgagataaacaaagtacagtgtgaacacgctactcttattttttattattattctgaaggaaaaagagtaagtaaggaagtgattttgactaggcaagaaaatgatggtaataaagatgaagagggttggaaaacttttacaacttttgcaaaagctacaaattcttttcctgctacatttaaaaccatggatgggtataaattaatacccacagctatttcgattttctcaacacctggtgatgtgtattatattgcaggtcagtataaagattctatgtttgatatagaaaagaaagaaatacatctagagcttttgagtgatcctgtttgtataagtggattatcaattggatttgagagtgttgatgcatacccttcaaatgctccttttcattcatctaattataatgaagttaaacctgtactttttgatgaacatactataattattcctatgtttttctgggttgctagtacgactgatgcaatacaagaagagttaaaacggcattcctttatgttggtgtatgattctaatggaaattctgatagtaatttggggttgtgtttgttgcataatgtttcggatgatgaatataggataagaacattatatactgtacaatattgtgcgtttgatatagcgtctgcaattagccgatttgaatcggagaaaggaaataaacctagtagaatgacaatagagtataaagtgaattcattaagtgatcgtttagaggatgctaggattgaaaaatatactttagattataaatttcaatagaaaaacgctgctaacaaatagttgtacaatattatagaactcgttgaaaagcaacgataattagctgcggcgcaggcagcaattgaaggatagaaagataaactggttagaaagttaactttctgataattgggctgtaatcgtctcgtgagagaatgattacagccttttttgttggatgatgttatttttaattgtatttgttcagccctgataatcagccattaataatgatttgtttggtgattattataaaaaactaactaaatatttgtttaagatgaagaagtagcttaattttgcccccgaaaacaaaacatgtttttattttataacttaaaaagaaagaagatgaaaaagggtttattattggtagttgtaatgttagcaactatcgctgtaaaagcacaggacatttacgtaggcggatcattgaacgtatggcgtaacagcacaggcaacactacttcttttaaagttgctccggaaatcggctacaattttaatgaaacatgggcattgggtgctgaactgaactattcacacgaatatgtgaaacaagtgactgcaaattcagttactgttgctccgtacatccgttggtcttactatcagaatgatgctgtacgtctgttcctggacggaactgctgctattggtttcgtgaaaatcaaagatggtgataccactaaagcaggtcagatcggtttgagaccgggtatcgctgttaaactgaacgatcatttctcttttatcgccaagtatggtttcttgggatatcgtaagaatgtgaacacttccggagattctttcggtctgatgttgactagcgaagatttgtctattggtttccactacaatttctaatcgggtagtagataataaaaaataggaaaggggattctctgaaatagggaattccctttctttgtgtgtaatctctatattttacacgtttgttaacgaaaaagttgtttgatatatatatcaatcatatatttgcattgttaattaaacagatgatttaactatagtattaattaaaactttagaattatgaaaaagagtgctttatttattttatttgcgctgatttcagttgctggcttttcacagattacaggttggaatgctaaggtaggaatgaacattagtaattatacaggtgatgctgatttgaatgcaaagattggctttaaacttggaggtggttttgaatatgcttttgataatacttggtcattacagccatcattgtttttgtcgactaaaggagcaaaaaaggatggtaatagcataaatgcaatgtatttggaattaccagttatggctgctgctcgttttaatgttgcggataatacaaatattgtggttaatgctggtccttatttggcatgtggtattgctggtaaaaccaaaattgatttggggaatgatacggaacgtaagtatgatacatttggtgatgatgctttaaaacgttttgatgccggtcttggtgttggagtagctttggaattaggtaaggttattgtaggattggatggtcaatttggtttagtagatgtagaaaaaataggtaatcctaaaaatacaaacttttctattgtattaggatataaattctgataagaaaattactaaaaagtaaaccgctgtaaaagattacttacagcggtttctttatttatgattgtatataatattcgaatcgatatttcttagtccgccaatttctttaactttttgaaatgctcgatcacagccagataattctgatccagacaggcatcaaatttattccagagatcccccagtacaacagcccctccaaatccgaaatcttttatttctagtagattatcttcattaatacctccaagtgccattacttttgagtcaatgatcttagctttctgtgcctcacgaagttcttctgccgtataagtagaatagtaattaaccttcgaaatactatcgtaaatgggactcatgaaaacgtaatcatagaaatgctttctgttcttcacctcttctacggaatggcaggaacaactgacgtgtccggcataatcatgcggctcgctcgggttgcgtgcattcaggtggatacccatcagattgaactcttctttcagataaaaatgttcgtgtgtcacaatgcggcgatgatatttttccggaatcagcgtcagtaatcgttcggaatacatggccggtgtctcaggttttctgagatgtagaatatccagtccctcctcgaaaagagcggtaataatcttatcttcttcaacgaagaacgtgggcgtggtaactacaattagtttcatttcctttgtaaagttgtaaagtttagcaaagttactaattaactatttcagaaaccaacgtttatagtgaaaatttgttagattgcaatgtacgcaagtcaatagtccatagtttacccgataatacttcgccaaaaccacagataattttcagcacttccgttgcttcgatgcttcctgttaccgcaggagtaatgcccattacacctttgggaggcgggggcattcgtctcatttcttcttcatccggatataagtcccgataactttttttctcttctccgtaatggaaaacggatacctgaccttcaaagccgcagattgctccatagacatacactttccccatttccgcacagatgtcattgataagataacgggtagagaaattgtcgcagccatctactactatatcatactgactgataatttcctgtgcgttttcctctgtcaaacgggttggataagtccggatagttatctcgctgttaagtgcggaaagtcgttcggcggcacatattgccttgggtttacctaattctttctccgaatagagcacttgccgttgcagattactgatactgactacatcgtcgtctaccaatccaatgcagcctactcctgctccggtcagatagagggctatgggagagcctagccctcccacgcctacaataagaacctttgcttgcttcagtttctgctgaccgtcttctccgatttcgggaaggagcatttgcctgtcgtaccgcatcgttttatcttttaaagtcaaaagactggtcccaatccttccagaccggttcacgtcctaatttcctcaggtcgcgttccacttctaccgctttccgttcgtcactcacgtggaactgctccagcgtttgcgggtagctgtaatatccgcccggttctgttttgctttcggcactcatggttgtcacgcccagtgttgccatgtgatttcgtatcttggcgctttcacgggtagaataggagatgtctacatcgtggtcgaagattcgcatggcgaaagtaagctgtgcaagttcccggtcgttcatgataacgttgggttggaagccatcgttttcggatggacgcatacgggggaaattgacgctgtatttggtcttccagtagtgcttctgtaggtagcggaggtggtaagccatcattgtcacatccgtccgccattcctccagaccgatcaggacacccatgccgatcttatggacaccggcctgtcccatacggtcgaaaccattgacacgccattcgaatttggacttcatgcctcgcgggtgatactttttatagttcgccttatggtaagtttcctgaaagcagatgactccgttcagcccgtgatgggtgagttctttgtattcttccgctttgaggggcatcacttcaatctgaaggttgctgaaataaggttttgccaggtcgagagcacgggcaatgtaaggtacacctgctgctgccggattttcacccgtcacgagtaaaagattctcaaaaggagccagccgtttgattgctttgtattcgttgacgatttcctcctccgtcagaatcgttcttttcatcggattactgatatggaaaccgcaatagacgcaggagttggtgcatgaattggtgatatagagcggcacaaacatagagattgttttgccgaaccgctccatcgtatatttctggctgaggcgggccatcacttccagatagggagtggcggcaggtgagatcaatgccataaaatcgttgacatccagatgctcttttttgcctaatgcacggcgcacatcggcatctgttttggaatagatggcttttgtcgtctcttcccaggatattttttctaattcgtctgagaacattttaattaattgaaagttgaaaattaaaaagaaatgaggttgtgacttggtttggggatattcacaactcattatttatcactcttggcatttttcttcagatcacgggataatctcatggcgcagaaatttggtccgcacatcgtgcagtattctccgtcaatgtgatgtcccgcgcggaaatatccctgtgcccgttccggatcgagagacaagtcgaactgatctttccagcggaactcgtaacgggctttgctcaaggcattgtcgcgtacctgtgctcccggatgccctttggcaaggtcggcagcatgagcggcaatcttataagtgataacccctacacgtacgtcttctttatccggcagggcaagatgctctttcggagtgacataacaaagcatagctgtacctaaccagccgatttgagcagctccgatggcagaggtaatgtgatcgtagccaggagcgatatccgtcactaaagggccgagtgtataaaatggcgcatcatggcatttctcgatctgacgttccatgttctccttgattttatgcatcggtacgtgtcccggaccttcgataaatgcctgcacgttcttttcccatgcacgaagtaccagttctcccatcgtgtccagttctgcaaactgtgcttcgtcgttggcatcatggatagagcccggacgcagtccgtctcccaatgatacggcaacgtcgtattgagccagaatatcacagatatcgtcaaagtgttcatacaggaaactttcctgatcgtgcaccagacaccatttactcatgatgcttcctccacggctgacaatgccgcacagacgtttatcggcaagatgaacattatgacggcggatacctgcatgaatcgtaaaataatctactccctgttcgcattgttcgatcagtgtgtcccgatagatttcccagttaaggtcttccactacgccattcactttctcaagtgcctgatagataggcacagtgcctaccggtacagggcagttgcggatgatccattcacgtgtctcatgaatattttctcctgttgaaaggtccatcagcgtatcacctccccatttgcagctccataaagctttttccacttcctcgtcaatgctggaagtggtggcagagtttccgatattcgtattgattttcactaggaagttacggccgataatcatcggttcggcttccggatgattgatgttggcaggcagcactgcatgtccttctgctatttctttacggacaaattcgggagtaatgtgagtctcgattcccagttcctcacagttcatattttcgcggatcgccacatattccatttccggagtgatgattcctcgtttggcgtatgccatctgagtgatggcttctccctttttggcacgatagggaagggcaatgtgttcaaagcggagatgatccagacttttgtcatcacgtctcatttgtccgtattccgaagtgatttcggggagttgctctacgtcaccgcgtcccacaatccattcttcacgtaagcggggaagtcctttcttaagatcaatgctcattgacgggtcactgaacggaccgctggtgtcatatacatatacttccggattcggagtagctatcttttcttctccttcgaagctgacactgggcacttgttcaactttccgcatggctacacggatgttcggatagagtttacccggcagatacactttctgagaacgggggaattttattttttgttccatagaattttattatcatatcattaagaatagtgaaacaaacactactccctacttattacctattacttatcacctattacttattccaaaaatgcagttaaaggtgaacttgcttctgctataaagttatcagcctgcagacccagtcctgcttcgtatgcccgtcttccggcttcggtggcggctttgaaggccaacgccatttctaccggattgcctgctacggcgatagcggtatttaccagtacggcagaagcacccagttccattgcttcggcagcgtggctcggtgcaccgattccggcatctacgacaacggggataccggcctgttcgataataatctgcaggaattctttggtttgcagtcctttgttagttccgatgggagcacccagcggcattacggtagcggcaccggcttcttccagtcgtttgcagagcacagggtcggcctggcaatagggtaatacgataaagcccagtttaacaagctgttctgtagcctttagggtttcgatagagtcggggagcagatagcgcggatccggatggatttccagtttcagccagttggtaccaaaagcttcacgtgccatctgtgcggcgaaaacagcttcttccgcatcgcgtactcccgatgtgttgggtagcaactggatattcggatgaataatatgtttcagcatgtcgtcttctttgtcatccatgtcgatgcgcttcatggctacggttaccatttcagtgcccgatgccagaatggcttgttccattacttcattggaattgaattttcctgtacccagaaaaaggcgggagtcgaactcacggcctgcaattactaacttttccacttttcaataagtttatttgattatacgtttcatgttcaaaatctttcgtgtttccgctgccggatcctccgcccgaagaatcgttcctgaaagcgcgattccgttcactccggtttcgagtatggcgggtatatcctcacgggtgattcctccgatggctactaccggaagttcgatattcgcttccttcatctgagataaaatagcggtataaccttccagtcccagtacaggactcaggtttttctttgtagtggtaaaccggaaaggaccgatgccgaggtaatctgctccggcacggtagtgctgtacgacatcttcgaatgtatttgccgtacctccgataataaatgcttctccaagtaattgtcgtgcctgatctatcggcatgtcttttttgcccagatgcactccgtccacttccagctttttggcaagttcgacgtggtcatccagaagtaagatcgcttctttttctttgcagagcggctttagttggagggcaacagcttccacctcttcacacggagcttccttcatgcgtagctgaatccacttacatcctccttcaagtgccatgagtgccgattcgaaataagtataccgatcggtctggtgggtgataaattgtagactgaccatacttttaccctccacaagccgctttgatgaccacgaggttatcattctcctgtaacgcgaatttctcccattcggaacgtggaatcattttgttgtttacggcaatagcgatgccttgtaccggaagttccagttgggcagccagttgtgtaagggtagaagcaggagtcatttccacctctttgttgttaacttgtactttcattgtcctatcagtattaataagttgaaagtaaatacaaagagcgtgcttatatagaaaggcgataagaaagaaacacaatccctacgtcagtgctaactgcctcaggttcctagggtataatctcagcccctctttgggggcacccctttgtctttacgggagcaaagtaagcgaaaaagaaacaaagattcatcaaattatccgtttttttttcatttttcttccgattcccgctttttgatgggatgagaaaagacaaaccgtgctccgttcttataattcttgtcaatccagatatcgcctcccatgcgttgtatggtcagtttgcaaatcgccagtcccaagcctgttccctgcacaaattcgttgagcttctcaaaacgctggaataccagttcctgcttgtcttcggggatgcccgcgcctgtatcggtcacagagaacagcatacactggtcttcttcgtctatttcataatccagcgtgatacttccgccgtcgggagtaaacttcagggcattgttcagtaagttgatgatcacctgctgcaaacgtagcggatcggtatagagcatataaggctctttcggcatctgaagcctgacatctatatctcttgtccggttctttctggtcagtgtgatcatgttctggcaatgatttaccagttcgcaccattcatacttgaacagcagtttgcctgattccaagcgtgatacatccagtacatcactgatcagttgcaataacaattcggaattagtctggatgatatccgcatattccttctgctcgtccgttgtttccacggtatcgatcagcaggctggaaaagccgacaatggcgttcagcggtgtccgtatttcgtggctcatatttgatacgaaggcacttttcagttgattggcttcttcggcacgctctttggcatgacgtagtgcaatttccgataattccagtttctttttatcttcccttagttgggctgtagtcttctcaaggtgattctttaagatttttgtccggtaataataatacagtgagataaacagtccgcctatcagtacaaggaaggtaaacaggatgaattgcacttccgtccgatatgcctgaaagaaaggcacctgttggttgatgataagtgaattgaaaggtagtttcttgtcctgaaatccccattcatgcagtttgttggcatcaaatttgtatctgttgggcaacaaatgaatgtggctgacattgtttttccccttgtccagaaattgataagcctgttctcccatgcttctccctattccgtcgtactgggggatataccctccgattgcccaataaccgatggcagtagcagtcaggctgaaaacaggcaactctggattcgctttggagaaagcatatacagagttgttcatatacgttatgccccgattgtcaattctccagatacccagtagtgcaaccgaattttgggggatatcgcgtagttgtttgacggcagcatcaagggtgtggatacggccgtcaatataggtcgtcgatatttccggatagcgtttcatattctttttcacccacgcttgttcggcaagtccgttgtaggtgttgtccgagatgaacactaaatgtttcatatccggataaaagcttcgcatcatttctatgtccttgtcgatatcatattcatatgtgttacagtatattatattgtatttattcattctttccgttaagtcgatgctctgaggttcgtaggtctgtatatcaatagagtcttccggaatacggatgccgttgcgcgatgccatagcgcaaaatacgggcagttgtctgtacttctcgtcttcaaggtgcaggaaactgctccacgcttcgccacccagcaggatgaccagcttggcgttcggatgtttgtccagaatgttggtaagtctttttttccattttctggattgattgaggtcggtaacattcatgttttctacgatggtggaatacttgccacccagttggcggtacgtttctacgaacgtgttgatattatcgtaggtatatttagtatcggaattataggacgtcacgaaaagtatctcctcttccaattcttccggggtagccgcgttactgatgaaagagagcaaaaggaagaaggcaacaaagaaaatgcgccattctttatttttttgttgaagtgtcataattgtctgttttgattttcggctattgcaaaaatacaatttatgcctttgaaatacaatagaaagcttagtttttttgttgtagaaaaaaggccgctgtgaaatccacaacgaccttttcaatagtatagtttagcttaattttaatgagtccggttacattcgtttttctaccacatcccagtcgatgatgttccacagggcgtttacgtggtcggcacggcggttctggtagtccagatagtaggagtgttcccacacgtcaaaacccagaagtggtttcagtccggcgcgtacggggttaccgccgtttccttctttggtgatatgcagtttaccgtccttgtctactgacagccaagcccatcctgaaccgaacaatccgactgctgctgcattgaactccttcttgaagttttcaaagctgccgaaatcacgtttgatggcttctcccagtttgcctgccggttcctttttcgaaggtttcggagcgaattggaggaaatataaattgtgattcaacacttggccggcgttgttgaagatagctccatcgggagcggtggcaacgatttcttctaccgttttgccttcatattctgttccgggcacaaggctattcagattatttacatatgtttgcagatgttttccgtaatggaaatctatcgtttgctgactgattacaggttccagcgcattgtttgcgtaaggaagtttaggcatttcgtaagtcatggtcataattattaaagacattaatatagtattcatattgtcaaaactttaaatggttttgttatactataataacagccatagttcgcaaaaggttcacggtattttatttttatttataaatgtactgtatacgttccacttgctgcgggttgtcatagctggtgcggcatatccattgccccgtattgtcatattcgtaataggagtcaccatcgatccggttcccgtactcgtcgtacaggcaggtcaggcagccggacgtcttctggctgttgccgaagatacgttggtagacgatgcgggtgaggtatccgtatttatcatattcatacaattctttttgcgagagaatctggttgggcgaattgacaaagagcatattctgatgctgagattcggtcattctgcctttgtcgtcgtatttgttgactgtatatccctccatttccccgttcttgttgtactctttggtttccgtcagtaatccctgcttgttgtagctgctgacggtatatctgccgtccatgtattttagggaatcgctttcgatgcttccgtcgataccgatgcggcgtgcacggcggtagaagtccgttttggttttcggattagtcttcacttcgaagatgcagtggccttgcgggtcgtacagcctgctggtttgcacctcgttgatgggttgcccgttcttttcagtcacggataatgtggtggtaagctgccccttgtcattgtaggtgtagctggtcgtaatattgccggtgctgtcggtctcgcagcactttatcaatcgtccttgagtgtaatattttacagtagtcggggtggaaacgatggcttgcaggataaatggagcacgcaaattctttgcctggtcacgaaattccttatacttgtgtgttttgaggaattcctgcaataaaccgagcgattcggagttgactattgccggtttcagaagctcgaagtctgccttttcactgagatattcaagatcgttcaggtgagtccgtgcaccggtggacagataaggtgtgttcttataatcatcgataatctgccggatggcggtggcatttccttcttttttcaggctgtcgatacgttggaacaggaaatcatcgtataaggtacggacctcggcaagataggggcgcggacctctgtcttgataatacttctgcatttcggggtcttcaaagaaggctttgaagtttgcaggagtcggggccgtcttcaccagttggtagagccgtacgttttcggaggcgttgacttgtgcgataaatttgccgttgggatactccttgacgtaagtctggtaaatgatgggagtgggggctttgagcattccttccagcagtgccacctcgcggatgttctgcagccgttgcagcatggcggagtcaaccggatattcggtggcgtgaatgctgtccagcagtgcccggctgaaaggtattttatcttttgaggcctccagcaggttgataatggactggtccgccttgtcccgtatctgagaaagcggaatcttttccccttcgcagatgccggggaagttactttgggcggctttctcgtagcagccgaagtagagggtggctgcctgttcgctctgttcgttccacaggtcgttgaggacgtccatcaatgataaatcttcggcatagtacgcctttgtttcgtcatccagtttttccctgttcttctgccatttgtcggcgtcattgtcgttcagataccttagcagcttttccatgcggctttgcttttgtgccattgcttgctgtggtatgcaggcgatgaggcacaaacataaaataaatgataaaaatatactctttttcattgctttgagtggttaggttaaatagttagtgatgaaaaatcataaaaatatcttcattgtcaaatgaatgttatacttttgtcgtattgaaacaaatttgaacgccaagggtttgttaaaaatcctcattgtttttataatgctgttatgaataccaactatatagaggaattaaatgagagtcagtgtgcagcagtgacttataacgacgggccttcgctggtgatagccggtgcaggttcgggaaagacacgtgtgttgacttataaaattgcctatctgctggaaaacggctatcaaccgtggaacatcctcgcactgacctttaccaataaggcggcgcgtgagatgaaagaacgtatagcccgtcaggtgggcatggagcgggcacgttatttgtggatgggtaccttccattccgtcttttcccgcattctccgtgccgaagcaaagtatatcggattcacttcccaatttaccatttatgattcggcggatagtaaaagtctgatccgttccatcatcaaggagatgggactggacgaaaagacatataagccggggatggtgcaggcccgcatttcaagtgccaaaaaccatttggtttctcctacgggatatgctgccaacaaagaagcgtatgaaggagatatggcagccaaagtgcccgctgtccgtgaaatatatacccgttactgggaaagatgccgtcaggcgggagctatggatttcgatgatctgctggtgtatacgtatattctgttccgcgactttccggaagtgctggcccgttatagggagcagttccgttatgtgctggtggacgagtatcaggatacgaattatgcccagcatagcatcgtacttcagctgacgaaagaaaatcagcgtgtttgtgtggtaggcgatgatgcgcagagtatctactcttttcgtggagcggatattgataatatcctttatttcacgaaggtttatcctaacacgaaagtctttaaactggagcagaattatcgttctacgcaaaccatcgtctgtgctgccaacagtctgatcgaaaagaatgaacgtcagattcggaaagaagtattctctgaaaaagaacgaggcgaaccgattggcgtgtttcaggcttacagcgatgtggaagaaggggatatcgtagccaataagatagctgaactgcgtcgggaacatagttacggctatgccgattttgccatattataccgtacgaatgcgcagagccgtgttttcgaggaggctcttcggaaacgaagtatgccctataagatctatggcggactttcattctaccagcgtaaggagattaaggacgtcattgcttacttccgcttggtagtgaacccgaatgatgaagaagcattcaagcgaatcattaattatcctgcccgtggcatcggtgatacgacagttggaaaaatcatctccgctgccactgaaaatggtgtcagcctttgggcggcgctttgcgaaccattgagctatgggctgaatatcaataaaggtacgcacaccaaactgcaaggtttccgtgaactgatagaaggctttatgaccgatcaggtggacaagagtgcgtatgagataggaacggatattatccgccggtccggcatcatcaatgatgtctgtcaggatacttcgccggagaatctgagtcgtaaggaaaacattgaggaattggtgaatggtatgaatgatttctgcgcgttgcggcaggaagaaggcaacccgaatatttctctgacagatttcctttcggagattgccttgcttactgatcaggactcggacaaagcggatgatggagaaaagataacgttgatgaccgttcattcggccaaggggctggagttcaaaaacgtattcgtagtggggctggaagaaaaccttttccctagtggtatggtgggcgattctccccgtgctctggaagaggagcgccgtttgttctacgtggccattacccgtgccgaagaacattgttatatttcttttgccaagacccgtttccgttatggaaagatggagtttggaagtcccagccgtttcttgcgggatatcgatgtgaattatttgcggttgccgcatgaggcgggagtcagtcggtcggtagacgaaggtgcggggcgtttccgcagggagatcgaaggtggatttacacgtgcggcatctcctacacgaacgccttatggtactaaattttccgatcgtgaacgtccgaagactcaggtgattgcacccagtgtgccgaagaatttgaagaaggtcagtgcggtgagtggaagcagtacacggtcggcttcagccggttcggcatctgtaacaggagtacaggcggggcagatgatagaacacgaacgtttcggtttgggcgaagtgatcagggtagaaggaacgggtgataatgcaaaagcaacgattcattttaaaaatgcaggggacaagcaactattgttgcgttttgcacgttttaaggtgatagagtaatcatagtaaaattagagatgatcatgaggaaacaactaactgtaattctgctttctgctctgatgttgagcggatgtgcatcgggacgtatgggaaatcccggagcaattgtaggtggtgctgcaattgggggaagtctgggaagttcgataggcggacttatcggagataataatcgtggctggaggggcggatatcgcggctctgccattggaaatattgttggcaccattgccggtgcagcgatagggaatgcgctgactgctccgaaaccggacccgatagaggaatatgcttacgttccggaagtcagacaagggcagtctcactctaagtttaaacctcggacgcagactcagcagcaactgactcagttgaaactgcgcaagattcgctttattgacgataaccgtaatcatgcgatagacgggggagaaagcagcaagatcatctttgaaatcatgaatgaaggacgaaatccggtttatgacgtggttcctattgtagagacggtcgggaaagtgaaacatatcggcatttctcctactgtaatgatagaagaaattcttccgggtgagggtatccgctatacggctacggtctatgccggaagtaagctgaaagatggtgaagtgactttccgcgtagcggtgtccgatgagaatggagtaatctgtgattctcaggagtttacgctgcctacgcagcgggcggaataggacaagaatagctcaaaatattcgatttgttatagtgacagtatgtgctcgggatagtgacactatccttggcacatactgtcactatgttaatgggatggtgacactatcccaatacaatagtccggtgcactcattacacaataaaatgaagtatcggtttcatctacacagaagcattctatatgagtatctgtcaaaattttacgtatcggttttccttcccagtcgaaaacccaaatctcgctgtttagagtttctttttgttcttcgtgcatccgattggtgtttgggttatacagtacataaacatagttattggaaacggcaatgcctcgtgctcccagttcggcatcaggattatcactttccgcatacacaccgtctgggcttgaattgaactgataatgatagggtgctaacaatagtcttttatggagcgttaatgtttccggcttatagtcccatagctcaagtacattactggtagcacatgccagacgtttccggtcggtgttgtaaccgaattgtgattgatgaaacatacctttagccgtattgggtatggtttcttctccactttgatagttcgggaagtcgccagatttggatataacattgccgtcattatctaaaataaggaatctgcaatcttcaaaaacaccggacgctataaagcgtgattcgctcatcggatagactctgtcaatgctcatgggcaggtgtatcaattctccttgtcgccggatggaaaagtctttcgcgttgaatgtatagttttgcgctgtgaagtgccatcgattgtgtatgaaagcagacgaatcagacagaaagaattcgacagggcttaaaaattcatcaggtccttgtccttgtggtagcatttgatttacaaagcgttgttcactaagactatagcagtataaaaggctgtctcctttaaaatcaccggcatataagatatctcctttcttttttatatccattggaatggagataaaggcttccttcaaagcggtagatttagcagttgtgctttcgctaaaggatactcttttctgtgattcactacaactgaacaatggcaatgccaaagtaaataatagaatgatgtttttagatttcattttgttttgctttattttgtactataactacaaagataacgtatgtgttttgaaaaacaaggatattgaagagaaatagggctaaaatatttatagtgagaacataataatataattggtattcggtaattaccatatattgtgttaactttgtgatttatttgatggtaattgtagttgcgtttttgctaaagggtatatttattgccataaatagtattgatccacataccaaagaacttgtcggtaaccgaatatactttattgatttctgtaataatgtctttttcaagcagttttttagttgcggactgtacagaacttgcggatgtcagactgtatcgtttgataaatttcgctgatgtgacgttttctgcttcacctactttggcaatggcataaagcaattccttttgcttttcgggaatattagataagatttcccgaaagattgtatcattatatgcaataaggttatctatagctgttttgataatttccagtgtacattctttccctttcggtgtatctgcaaaagcttcattgaatgttttttgaatataaaaggtatgtcctttgaatagccgatatactttttctatattttcgatttcaatatgccgttttcttttttggaaatggtctgcgataaatggtatatagatttccggtgcaatggctttcagttccaaaatatcggcactgtggtagaatggacgggatgaagatagaaacatttcctgcatcatgtgccgttcacttccggcaaagatgaagttgctgttttctattttctgtatgtgtgtgcgtagtaatgcttctatattcttctcgggatatttagcaatttgttgaaactcgtcgatggcaacaatacaaggtttgtctgctgctatcaggcattgaaatatttcttccagtgtatattcgggtcgatcaatatcccccagttccagattgaaagtaggtagattggtcagcgggtcaaatccgaatttaccattgattgatttaagtgtctggataaacaggctcgccattttcttactgcggggcaatagtgtttcataaatttctttgccaagcagataagtgaattctcttaagcttgatgtatggagtatgtcaatgaagaaagtataatattcttcttttatttcaggtttctcataacagaaacggattagtcccgttttacccattcttctgggtgagataatgacaaggttattgccattggttaatgatttaaccagcctctctgattctttcacgcgatcgcagaagtactcgggttctatttttccagttactataaatgggttaatttcttttgccatacctgtttcaattttccgtaaaggtagttatttgaatagaattatgcaaatcgaataatgttaataaagtatctagtcttgttttatgcttattggatattgaatattgttaacaaacttattttttttgctttaatatggtccgtttctttaaaaccaaaggcccgttggttttaaagaaacgggtcgttggttttaaaggaacgcccttttggttttaaaggaaaaatggcgatttgtatattattgataatcagtagcttgataaatcctgttttcagtcttattaaatagtaaaatatttatataagtatagcttaataaataagagttttgatgctacaaacatttatattatgaatatttgtctgactacaaagtggcttttcttctattaagttatatctttttttaaagagaaagtttagattgttgtgaaaaatgttatctttgtagtacaaaacaacataaagtaaagcaaaatgagacctaaaatcataattctgttatctgctatagcttgtattggaggaattgtattcttccttgcatgcaaatatacttatgaattcaaagtaacggagcttaaggagaaagcgaaagagacttttactgaagcactggataaagagttgaaaaatagaaatataaacggaggactgtcattttactttaattctgaatcggctatctctactgaaatgcctgattcagtttattgggaagatgcgtcaggaagacatttatatcggatggattccaagaaaaactctatgaatattactcataatagtaatttacgtgctttgcatacttttattttttatgaaaagccacttcagcctgactctttaaatcttatatgggatgaacaattaaataaagcagatatttatttagaatcagctttacgtatttctttgacgcatgaagacggtagtgtagaatctcaaaagacctatcagagtgaatggggcaattcttcaaatttagtttttactttttatataggttatgcctgtgagatagaagtaatgggttatttgcattacactctatgggggatgatatataaagaggtgctgctatatttattgctatatataattgttggatatggattttatacgtttttcataattctcagtcgcaggatcaattcattacgtagtaaagaaatagtcgagattatcaaggagactcccgtggaaatcttaaaagaggttcctgtggaaattatcaaagaagttcaggttgaaaaacaaataattaaagaagtacagagagtggatattattcccttacattcttacatattgggtgagagtctaatattctatgcagatcagaatatcatagaggtaaatgatgttaagtataatattcaggggcagtccagtttacttttagaactattttttcaagaaaaagataatggctatacattaaaggaagattttattatagaaaaattgtggcctgataattcaggtaatgatgagcgaatgcataaagcgattggacgtctgcgctcgtttcttagaaaaatagatccttcattgagtataataaataaaaatggtacttatcgactaattatatcagagaaatctcttgttaagagaaatagctaaaaatgtcgatgaaatggagctattttgaatttcaacttgatttcttcggataaaaatgatgcgaggtcaggattggtcagcggtattctttgctaattaagtgcttcattactacttttgctctcagaattaatctttaacgcaaaagtagtatgaaaaaaaatcttcttcttttattatgtatagtagctattttatctactaaatatttggcttctcatgaaaagagacaaagtgctttattgttatataacatagaagctttagctgctaacagtgagcatgcagatattggacattgttatggaacaggtactttagattgtcctgtatctcacgataaagttaaatatatcgctggaggatatagtcttgaaggtctttattagctttcttcttctctttatctgcatctcttgtggtacaaaaaatatggaatatgcagagaatgtatttccttattctgaatttccacaagagaaggagctaaaaggagaggtgatagagcttgatactgccttatttcgctgtccatttcggatacgagtagaaggagataaagctattgtaatggatttgcatggtatcgattattatgctcatttgttcaaatatcctggctttcaatatttatcttcttttgggaggcgcggtgattcaccaactgaaatgctatcaatggataatgttcgtttttacaatcataaagtatggacattagatgctaataaaagagaattaacacggttgggtttttcttcatccggtgattcactgctccgtgacgaagcggtgatattggatgaagatattttaagaccacttgactttgccatatataatgatactacctttataattcctgattattccggtgaaaaccgattatgttggcttaatgatgatggggaacttgtaaaaaagataggcgctatcccatcaattaataatcaaacgttacgaaaagctcgtccagcattggcacaggcatggcgtagtttcattgattataattctcataacggtgtattagcaatggtgactcaactaggtgaagtacttgaagtctataatttgaaggatagcacggaggttattcgtattggtgaaaacggggaacctaagtttaaaatatttgaaggatatggaataccttcaggaattatgggctttagcgatgtgcaagtaacagataatgccatttatgcagtgttccatgggactacatttaaagagattgtaaaacataatggtcatcttccagatggaggaaagtatatttatgtattcagtttgaaaggagaaccactatataagtatgtgcttgatcactatgtatatggtttttgggtggatgaagctacaaaaacaattatagcgacagatataaataatgatcagcctattgtgagatttcaatgtggttgaaaaaatagatagttaacgtgattaaaagaggagcaggaagatgggttagtcaattttgccggattggttcccatcatctgctactttattcctactaaaaagaaaggaggtgcgacaaagatagtgataataatggttatggcaaatacgtttttaccagatatagagaaaagtatgaaatgaaaaggtataaatattaaaaaatctacttaaatgaaaaagaaattaatgggcatagttactattattgcaattgctgctgttgcaggatataatgtatatgcttcgcggagtaacgtgaagttgtcggacttagctttagctaatgtagaagcattggctgattcttctgaaggttctcaaagtgattgtaacacatactgtatggtgagttattttgatacatgtatcattagatatacaaataacacttttactacttgttatgatagtagaataagaagatctaactaaccgattgtaaggctatataggtgcctactatttctatatagccttgctttaaaaaatgtaatcatgaatacccataattcttgtttaatactgcttttgacagtattattagtaacagtatcttgtgcagaaaaaagtggaagtaaatatcaagatgcaactttaattgaatatcaagattttgtatccagtcaaaaattgacagggataaattttttatcagataaagaagtattaaagccgatgcgtatatatgtttgtgacactattctgataacaatgaaccctatggagaagaagctgtttcatctttttagtttaaaatctaaaaaagaaataggaaaacgaatttcgcttggacaagggcctgacgaaatgattcgtccttctattataaaatttaatgagaatcagattctaatatttgatgttgccacttttacgttatttacgtatgataccgaggattttatttcaaatgaaaatacgattcctttagaaaggaagactatagagctacaagcatatggtgaaataggtttactctctgataatctaataggatcgacatataatcctaaaaatcaatttataaaatttgataataatggaaagaaggttggtgaatttggctattatccagtggtggcagacttatcatatacagacgatgagaaattggaggcttttaaatcttcttttgtgactaatatgaaagataggatagccgtttgttataaatggacagatttgattgatatctatgatcagaacggtcaattgaagaaacggattcatggacctgaacattcgtatgcacattttaaggaatttcgtaatggtaatgctattgcagctacctctgataaagataatatagatgcatatttctttccatataatgtaggagatgagttttttgtgttattcaatggaaagccttgggatccggatgataaagaagtagaattgccagatcgtatattcgtttttgattggaatggcattcctcagaaaatatatactttagatcaaggaataattaattttgctgttgataaagttcagaaaaagatatatggaattagcagttcaccagaatttcatgtggtggaattttcatataaataatagataaacgatgaaaaatatatgtcttatgttattgccattattcttgatgtcatgtttaaataaggataataacatcgtttctcttttgaaagaatgggaacagaaagaaattctgttccctaaagaaatgtattttacaacaatgttgagggatactacatattataatcttcagagtgagtataaaattttagcatatgttgattcgataggatgtactagttgtaaacttcaattgtcggcgtggagtatgttaattaatgaaattgattccttatatgcaggtcgggtcaagtttatatttgcattctctcctaatagaattaaagatatttatcatgctatattgactgctaattttacatatccagtatatgtggataaacaggatagcattgctaaacttaatagatttccattagaatcaaacctccacacatttttattggataaaaataatagagttattgctgttggtaatccagtttataatcctaaaataaaaaaactttatttcaatattatttctggtaagaaaccttttttaccgtgtaatgcagaacaaagaacaaatgctagtttggataaacgatttttagacatgggcagttttaattggaaacaggagcaaatatctgacattatattaagtaattcaggagaagaattattagcgatagaggatgtttctgtttcttgtggttgtattactgtggaatatctaaaagaaccgattcgaccaggtcagaaattaaatctgagaataaagtataaagcagagcatcctgagcattttgataaaacggtaattatatattgtaatgcagaaggttccccatttagactaaagataagtggaaatgcaaaataaagagggaatatggcaaagtgctttagggatttatcatatatatgtataatattatttattgttttgggatggcatattatggataacattgtatctgaaaaagaggtagatattacttctttagaagttgctttgcggtctgctggtgataatagaggggagctggaaaaagtcctttgttactataaaagaaaaaatacagatagcctgaaatataaagcagcctgttatttaattgaaaatatgccctttcatagatattcagttggagaacaattagaaaactataagtcatactatgcatggctgaaaaaaagcaagggaaaagaaccgcaacaagttgcagattcagttaagaaagtatatggtccaatgaaagaacccaataagatacgcgatattatggaaattgattctgcttatttgtgtcataatattgattgggcatttaaagtttggcaggaacagccttggggaaagagtatatcattcgatgtgttttgtgagtatttgttgccttatcgtattggcgatgaacccttggtatattggcgtgaaatgtactatgcaaaatataattcattgttagatacattgagaatgtcggattctttggatatagaagatccagtagtagctgctaattacttaataaataaattgcctgataagtggcattattatacttcaacaactccttattcctttgggcatatcggacctgaatatgtacaatacttgtcaggaacgtgtcgtgaagtgactgattttgctgtatatctatttcgggcattgggaattccttgtgctattgattttgttcctgtacgtagctatgttaatgctgggcatttttggttggtagcctgggataaaacaggtgaagcgtatatggctaattttcccgagaatctgggaatggtccgcaaaaattggtggtatcgttgggatgatagtccaaaggtgtatagatatacttttgatataaacaaagaattatatgagcaaatggcgaaatataatgaaaaggtatattcattttggagtctgccgaaatttatggatgttacttatgaatatgcttattcttttgaaaaggaattagtcattccattggaaaaactttataggaatcaatgtagtgggagaatagcttatttatgtgttactaatagagataactggataccggttgattggactgaatttgacgcacagcatctggcttttcgaaatgtacgaagaggtacgcttatgagggtggctacttacgagaatggtactttgaactttttgactgatcctttttatgtggataaacagaaaaaggagcagcattatttctctattgaaggaaatacacaagatgtggtattgtatgctaaatgtaatatagagggagaaaatatgttccgtgaccgaatgatagggggcgtttttgaaggcagtaaccaactggattttgcagtaagcgataccttgtttatcatacagtgtaaacctgatcgtttgaatacgacagtaagaagttcttcaaataaagaatatcgttatatcagatatgtaggtcctcccggaggattatgtaatgtggctgaagtcgcattttatgaaaaaaatgatactcttccattgtctgggaaaattatagggactcccggatgctatcaacatgacgggacgcatgaatatacaaatgtgtttgatggaaaaacgtggacttcttttgattattttaaattttccggaggatgggcaggacttgatttgggtagaaaggtgcagatagaccgtattgtatatactccgcgcaacagggataattatattcgtcctggtgatatctacgagttgtattattgtgatcgatattggaaatccgccggaagaattaaatctacagttgattcattagtatacagagggattccccagaatgtacttttgttcttacgtaaccatacgcgcggcgtagatgagagagtctttgtttatgaaaaaggagagcaactatggaaataagacttaaaattaaactagttgtgttgtggaagacaatcatcttattaggaataattgtcttgctatctgcttgtttccattcgaagaaggaggctgtatcttctattgctattattcctgatgagcatacgttactggcgattacgccggaattctctataaaaatggcaggaaatacattgaataaacattatctacgattgaagtctggaaagatatttccaatgacagggattttgcaggtagatggtaggacctatcgttttatgggggaagattctttacgtatatcccctatagcttctcttgcaaatgacagcgtcagttggtcagggaaatattcttatttgtttccaggaaaagggtgggagcaaaaggaatatgatgattctttttggaaagaaggaaatgcagcttttggacctgtaaaaggaaattctaagattcgtaccgcttggggggcggaaaatatatatgtccgcaggcatattaagattgataataaagatgctttggaagggcataaaatttacgtctgttatatttgcgatgatcagataaaacttttttggaatggagattttttatttgaaaaaggaataacatatcaaacgaaatgtggacgtttaacagatgaagctattgctcatattggtaatggaacaaatgttttggcagcttatggatgtaatacaggaggccctgcgttgttagattttggtctgtatattgaaaataaaacttatagtgaagcagatacggccctattgaagcaaatagatgtacaagctactcaaactcattatgtatttcaatgtggggatgtagaacttcagattgattttgtttcaccttctttgtcagagaagtggaatatgacaggatggcctgtcggtttcctttcctatcaagttcgttcagaagataaaaaggagcatacggtggaaattttgttcgatgtggatatggaatggatgtttggtaggaggaagattgatagttgggttgaacaagagtggcggtttgtcaagtctgatagtttatatttaggtctgacggcggatggaacatcgttttcatgcgatgatagtcatgttgttctgtctcaaaagttgtgtgcagaaaatggaaataaaggcatattgttaataggatacggagaagggcagaggatacaatatattggtgagcgtttacaacctctttggaatgacaatggaaaaggagaggttaaagaattaatgaaggctgttggaaacaggtatcagaaacttaaggaagaatgtaataaattggataatctgtggaataataaagcatttcaagtgggtgataagacatttgcagaacagattcttccttcatatcgtaattttatttcttcccataggtttgtgttatcttcggataataagtcattctgcttcggagatactttgggtaatgttagagatgcttataggagttttcctgctttgttattttttaatcgtgttgattggatgaaaagtttattaaatccaatatttgaatattgtgaagatgaacattggaaaagaaaatatccgccttacgatattggattatatccggttgcaagcaaacaaataaaagtggataattgtgctgaagaggctgctgcaaatatgttggtgatgacggttgctattgtggaggcagaacaagatttcagttatgctgaattgcattggagtcatttgtgtttgtgggcaaattatctggaagaaaagatgaaaggtgaagttcttccttctattgagttattagatgcaaatgacaaacgtgtgaaatgtgtgctgggattgatggcttatcataaattgattcaactaaaggatgcatatgaataaagtgaagaaatttctagcaataatagagaatttaatattcatgatattctgcatgatagtaattttgttcttggtacagttattctgtttcacatcgtttaaaattccatcagattctatgggacctgcattaaaagatggagatagaatattggttaataaaatgataaaaggagccagattgtttaatgtgtttgctgctttggataacaaagatgttactatttaccggatgccgggattggggcattttaaaagaaatgatgtactggtttttaattttccttatcagatgaatcggtgggatagcatccggatgaacgtaatgcagtattatgtgaaacgttgtatagctttgcctggggatacattggaaatcagaggaggattttataaagtgcgtggatgtcgcgaacagttgggaaattatgaagctcagcaatatcttgccgggctacagcaaccggaaaaacaaggaatcgtagtaggaacatttccttatgatcaaagcctaggatggaatattcgagagttcgggccattgcctatcccacaaaaggatcagattgtaataatgaaccatactacttatcttttatacagacaactgatcgcatgggagcaaaagaaaaaaatagaactaaaacaggaacaggtgtttattggtgatagtcttattcatcagtattgctttaaaaagaactattattttgtatcgggggataatatggcgaattcgcaggattccagatattgggggatgctgccggaagaatatattgtaggtaaagctacccgtatttggaactcaaaagaaaaatataccgatcagatacgttgggaacggattttaatgcagatcaaataaagatagaagatgttattacagaataaatatatcgttcatttattaatgctgtttggagtcattgcacttttaagtgttgtgactgtttcatcttatactattgcggtcggagatatggcatatcagaagctatatttggggcatatgtctattgtctttgtgatatgtactcttatgtctttgtgcttagattgtaagaaaaatgcattttatttatcagtcgtttggtctcttattattttaggtggggttgaggctgtttggggattaaggcagatatacggtttagctgtttctaatcattcattatatgcgcttacaggttctttctacaatccggggccttattccggatacttagcaatggtatttcctatttgtttgagtgaatggttgaatctaaaaaaggtgaagaaacgtacttggatcgagcaaagtaaatattgtgtggctttaggagtcttgctgttaattctttgtgttttaccggcaggtatgagccgttcggcatggatggctgttgcaatttctgggatatgggtatatgctacataccgttcatggggaactagtttaaggaagataggccgaaaatataagaaaagagtatttccggctattattgccgggggaatggtattgataatagttggttatgctctttttcaattaaaagtagattcggctaatggacgtctgttaatttggaaagtgagtgttatggctattgtggaaaaacctttccttggacatggtactggaaactttgcatcggcttatggaatggctcaggaaaaatatttctcccaaaaagagtttacatctacagaagaattagtagctggaagtcctgaatacgcttttaatgaatatctgcaaatagctgtagaatatggagtcttatttctattggttgtgttattgattattgttttttgcctttggataggaataacagagaaaagactaagtgcatgtgctggtttgatttctgttttagtatttgcattttcatcttatccaatgcaaatacccggatttgctatagcattctattttttattggctgcttgtgtagtgggttcttcacggttacaaatattgttctttattataatgattgctttattgggaagttactattggaaatataatcagtataatgcttgtgaagaatggtttaggtataaaatgcactataatataggcgcatttcgtttagccaaagaagggtatgagaaaatttatccggaattgaatgataggggagcatttttgtttgaatatggacattctttacataagttgaaagaatataatagttctacagcaattttgaaagaggcaatggcacatagttgcgatcctatgattttgaacataataggaaagaattatcaggctataggaaaatatgaaaaggctgaagagtatttcatacgatctactcatcggcttccgggaagaatttatccatattacttgttggcaaagctttatgcggaaccggaatatcgacatccggagaaattaaaacaggcgattcagattgtattgacgaaggaaccaaaggtacaatcgactgcaataagggagatgagagaagaagtgaaactgctaaaataaatgggtgaagaaaaaaaatgactgtacaaacttgattaatagatatttttgtctaaatttggcaaacatgatacaaacttacatacaatatataagaaattatatgtgagataatttagaataaacaaaccaataaatacgatgaaaaataattctacatggattttattgtgccttgcatgtatgatgacgctctcttgttccgacaagaagaatactgcagatgaatcggagaaaggtgtctccatagtccttccggatacgaagaatgaagtagctgttcagatattaaagaagcgtgattttcatcacgaactggtgagtaacggtaaaatcaatgcccgtggcaaagccgatctgcgttttgaaaccggtgaagtcatcgctcatatctatgtgaagaatggcgaccgtgtacagaaaggacagaagctggctgatctggataaattccgtctggaacagaaattatcccagtcggaagatgctttactgaaagccgaactggaattgaaagacgtactgatcgggcagggatattctcctgacgactttagtaaagtccctgccgaaacaatgaaaatcgccaaagtaaaaagcgggtatgaacagtcgaaatcccagtatgaactggcgaaaagagagatggagcatgctacgttgattgctccttttgacggtgtggtagccaatttattttcaaagccttataatccggcaaatacttctgaagcattctgtactattattgattccaaaggaatggaagctgatttcacagtgctggaaaatgaacttgcttttatcaggatgggagataaagtggtaattactccttatgccggaggagatgcgtttgaaggcagtgtatcagagataaatccattggtggatgccaacggcatggtgaaagtgaaagcattggtaaatgcgggaggaaaactgttcagcggaatgaatgtaagggtaagtgtccgccgttcgctgggagaacggctggttattccgaagagcgccgttgtattgcgttccggcaaacaagtggtatttaccctgaaagacggcaaggcaatgtggaattatgtgaatacgggactggagaatgcgacagaatgtgtcgtctccgacaagtcgcagaaaggtatcgaggatggtctgctggaaggagatacggtcatcgtcaccggaaatctgaatctggcgcatgaggcggaagtctatgttaaatgaagaattaagaattaaataatgaatctatgataaaattcttaattcagcgccctattgccgtattgatggcctttaccgcctgtttcatcatcgggctggtgacgtactctacgctgcctatatcgctgcttcccaatatcgctattcctgagattacggtacaggtggcgtctgccaatacctctgcccgggaattggaaaacacgattgtcaaacctttgcgggggcagttgattcaggtctctaccctgaaggatattcatagtgaatcgagagacggggcgggcattatccgcttgtcatttgaatatggaacgaatacggaccttgcctttatcgaggtaaatgagaagatagatgccgccatgaactatcttccgaaagaagcggaacgcccgaaggtaatcaaagcgagtgcaacggatattcccgtattctatctgaatctgacactgaagaatgacagtgcttacggagctacggaacagcactccttccttgaattgtgtgagtttgccgagtctgtcatcaagcgcaggatagagcagcttgaagaagttgccatggtggacgtgaccggaattttggaacggcaggtacaaatagtgcccgacaaggacaagctcgccatgatgggactctccattggagatatcgaatcggctttatcctctaataatgtggaaccgggcagcatgacagtgcgcgacgggtattatgaatacaatattaaattctcgacattgctgcgtacagcggaggatgtggaaaatatctatctgcgtaagggcgaccgcatcgtacagttaaaagacttctgcaaagtaagcgtcgtacctgtaaaagaaaaaggagtatccttgtccaatggaaaacgggcggtgagccttgccgtcatcaaacaggcggatgagaacatggataagatgaagcaggcgctggtaggcacgatgacctattttcagttagtatacccggagatcgatttcagcatcagccgtaatcagacggaactgctggactacaccatctctaatctgcaacagaatctttccctgggttttctctttatttgtctggtagcggttctgtttctgggagatgtaaagtctccgctggtcatcggactcagtatggtggtgtccatcgtgatcagctttgtctttttctacctttgcaatatgtctctcaatatcatttcacttgccggattgatcctggcattgggaatgatgattgacagttcgattattgtgaccgagaatatatcgcaataccgtgaacggggatactccttgcgccgtgcctgtgtgacgggaaccagtgaagtggtcacccccatgctgagttcttctctgacgactattgccgtctttgccccgctgatttttatgagcggtattgcaggcgctattttctttgatcaggctttttccgtcactgtaggcctgatggtgtcctatctcaccggtatcatgctgcttcctgtgctttatctgctggtttaccggacaggtgtccgcacccggaaatggaagtggctttctttcaaatttaataacccgatcaaggatcacacgctggaccgcttctatgatgcgggtgttgactgggtattccgccataaaacgttcagtgtactgttctgtgtgatttccattccgctttgcgtattcttctttttctttatagacaaagaacggatgcccgatatcgaggagaatgaactgatcgcccggatagaatggaatgagaatatccatgtggatgaaaacaaacgacgggtggatgaacttttcaaggaactgaaggatgaagtactggagcaaacagcctctatcggcagacaggatttcatcctcaatcgggaacgggaactgtcttcttccgaagcggaactttatttccgtacggagacttccgatgctattgcccctttggaacaggcggtatatcggaaactgaaggaacgttatccgctctctgtcatttctttctctccgccggaaacggtatttgagaaactctttgtgacgggtgaaccggatgtggtggcggaattttacacccgtaataaagcggaagcccccaaagcggaagcaatccgcagcatggaacaggaactgggacgaaaaaccggaatcaatccgacaggtatcgccttcgaaaaccagttgaatctgagtatcagtaaagagaaactcttgctctaccgtgtttcctacaacgaactgtatcgggtactgaaaacggctttccgggaaaacagtgtgacgatgctgcactcttatcagcaatatttgccgatcaacattgccggggatgaaaagactgtgaacgaggtgttgcaggaaacactggtgcagacgcaaccggacaaccgtgggaatgtcgattttatcccgcttcgggaattgatcaacgtagctcccgccgaagacttgaaaagtattacttccggacgtaatggcgagtatgtcccgttcgacttttacggcgtgcaggatgcgaaccggctgatgcgtgaagtgaaacaggtggcggaggaaacaggggactgggatacgggcttctccggcagtatcttctccaacaaggagatgctggatgaactggtcgtgattctgttgatctcactgctgctgatgtatttcattcttgccgcacagttcgagagttttctgcagccgttgctggtactggcggaaatcccgattgatgtggcatttgccttactcttgctttggatatgcgggcatacgctgaatctgatgtctgccatcggtctgattgtgacctgtggtattgtaatcaatgactctattctgaaactggatgcgatcaatgaactgcgcaaggcaggcgttcctttgctggaagctattcacgaagcaggccgcaggcgtctgcgtccgattatcatgacttcgctgacgaccatctttgccatggtgccgttgctgttctcctcggatatgggatcggaactgcaaaagccgttgtctatcgccatgataggcacgatgtccatcggtacggcggtcagcctctttatcataccgctgctttactggtttatctatcggggaaaaagcgggaatcacaaaccaaatgaaaaacatgttgaattatgaagaaatcatccgttctttttgtattgatggcagcatcggggatatgtttctcttcagtatatgcccagaaacgtctggtgctggacttgaaccagactatcgctttagctaacgacagttcgctggagtcattccgcacacaaaatatgtatctgtccggttattgggaataccggacgtaccgggcaaaccgtttgccgagtctgacaatggaccttaccccggcacaatataaccgggatatcacgaaacgttatgattcgggacaggacctggatgtctaccgtacgcaacagtcatattatgcctatggaggattaagtgtccgtcaaaatctggacctgaccggaggtacgttctatctggagtcgaaccttgcctatatgcgtaatttcggggataatagtgcgacgcagtttaccagcgtcccgatacggctcggttattcgcagagcctggtcgggtataatcctttcaaatgggaccggaagatcgaaccgctgaaatacgagcgtgtgaaaaaggaatttctttataatgtggaaaaggtttcggaaacggcgacgaattatttcttttcgctggcgatggcgcaggcggaatacaaactggcaaaggaaaacctcgcatctacggatactttgtaccgcatcggacagcaacggcaccggatcgccgctatttcacaggcggacctgttgactttaaagctggataaagtgaatgcacagaatacattgcagaatagggcaagcgccttgaaacgggcaatgttctcactggcatcttttctgaatctggataagaatacccagatcgaactggagcttccttcacgcccaagtatgatggagattccggtggatgaggctttgagatggggaaggagcaataatccgcagttgctggaactgaagcagaatgtactggaagcggagcggaatgtggacagaacaaagaaggaatcccgtttcaatgccagcgtgaatgccagtatcggtttcaaccaggtggcggaaagcttcggagatgtgtatcataaaccgatgcagcaggacttggtagcggtcagcgtatcgattccgctgctggactggggcgttcgtaagggcaaatacaacatggcacggaataatctgaatgtagtgaagatttcggcacgtcaggatgagatcagtattgaggaggaagtaatcatgacggtgagtgattttaatatccagcagcagttgattgccagtgcggaagaagcgctggacctggcgatactggcttataatgagacaaggcaacgttttattatcggtaaagcggatattaatagtctgacgctttcgctcaacaggcagcaggaggcgcagcgcaactacatttctgccttgcagaactactggctgaattattataaaatacgtcgtctgactttattcgattttgctacgaagctttctctttcggatcgtttcgactttaatggagggagactgatcagatagtaatttcttttgagatatagacaaatgaatcatgcaagatataggttctgaaattaagaagtcatcaaaggcttccgcttttacgctcattgtcgcttttatcagcgtggcgttggtcgggctggcacttgttccgttgctgccggtgaagctgaatccgtcacggaccttacccggattttctgtatggttcggcatgggagggacttcggcgcgtgtcgtggagatgacggctaccagcaaactggaggcgatgcttgcccgtgtcaagggaatacaaagcatatcttcgacttccggcaatggctggggaagtataaatgtgagtctggacaagcatgcagatgcggctgtcgcacgttttgaggcttcgaccatcattcgtcagacttggccggaattgccggcgggagttagttacccgtacattcagatggcaagtccggagcagaaaagtcagggaccttttatcgcattcacgattaatgcgcctgccactcccagtctgattcagaagtatgcggaggaacatataaagacacgccttgcgcagcttccaggaatctataagataaacgtcagcggagccacaccgatggaatggcgtctggagtatgattatgagcagttgcgtgcgttgggggtgagtacggatgaaattagtcaggcagtcggtctgcattatcagaaagagtttctggggacttatgatgtggaacaggcggcttcgggcaaggaatggattcggttggtgctgatgcccgaacatgataaccgggagtttgacgccgggcagatacaggtgaaagtgaaggatgggagaatcatccgcttggacgaactggtgaaggtcgtccgtatggaagagcagcctcagagctattaccggatcaatgggctgaattcgatttatctgtctgttgtcgctgaagaggcggctaatcagctggaactgagcaaaaaagtacaggcgtgtatggatgatatcagactgtcgcttccggcgggatacgagattcataccagttatgatactacagagtttatacatgacgagctgaacaagatttatttgcgtacgggagtgacggtggctatcctgctcttgtttgtactgctgattactttcagccccaaatatctgtttttgattgtcaccagtctgaccgtgaatatggcaatagccgttatcttttactatgtcttcggactggaaatgcagttatattctttggcgggtatcacggtttcactgaacctggtgattgataatacgattgtgatgagtgatcattatcttcgatgtaaaaaccggaaggcgttcatgtctgtattggcggctacactgacaacaatgggagcgttggtcatcatcttctttctggacgagaggattcgtctgaatctgcaggattttgccgcagtggtgatgattaatctgggagtttcattattggttgctctgttctttgtaccttctttgattgataaaatcgggttgaaacgacgcaggaagtcttctctgaccggagtgaagagaaaatggaaaatggggaatacccgtttcttaggatggctgcgttcgaagatgcgaagggggccggtctatttcagtcatttctacaggtggctgatacagaggctttgccgctggagagtagcggtttgtctgttgctgttgctggcattcggattaccggtctttctgttgccggaaaagatggatggggatggcaaatgggcagagatttataataagacactggggactcctacctataaggaaaaggtgaaaccgatagtggataaagcgttgggaggaagtctgaggctgtttgtgcaaaaggtgtatgaagggagctactttacccggaatgaggaggtggtgctttatgccaacgccaatttaccgaacggcagtacgcttgaacagatgaatacactgatcaagcgaatggaaacttatctgagcgagttcaaggagatcaagcagtttcagacatcggtagaaagcgcccgcagggcatctatcagcattcgtttcacaaaggaaaatcagaaaagcgggttcccatatacgctgaaagctaacatgatcagtaaagctctccagttggggggaggagattggagtatctatggattacaggatcagggattcagtaatagtgtacgcgagaacgcgggatcattccgggtgaaaatgtatggatataattatgatgaactttatagctgggctacaaaactgaaagaggtcttattgtctcatcgccgtatcagggaagttacggtcggttccaatttctcgtggtggaaggatgattatcaggagttttattttgagctggataaacaacggatgatcggagcggggatcggagccggagaactgtttgctgctattcgtcccatatatgggcggaatcaggaaatcggttccgttgttaccgaagatggaacggaaaaaatcaaactctcttcccgccagtcggatcagcgggatatatgggccatgcagtattatcctttccgtgtaggcgataaagagtataaactggcggaactggctaaggtagagaagggacagatgccgcaggaagtggcgaaggagaatcaacaataccgcttatgcctgcaatatgagtatatcggtgcgtcggaacagggaaataagttgctgaaaaaagacctggaagagtttaatgaacttcttccgatgggatataaggcggaagcggaaagtaataactggtcatggggtggaggtgccaacaaacagtatcgcttgctcctgattgtgattgctatcattttctttattacaagcattctgttcaattcgttgaaacagccgttagcgatcatctttgtcattccgatctcttatatcggtgtgtttctgacgttctactggttcaagttgaactttgaccaaggtggtttcgcttcgttcattctgctctgcggtatcacagtgaatgccagtatttatattttaaatgagtacaatgcgattcgaaaacgctttccctgcctttcttctcttcgtgcttacgtgaaggcatggaatacgaaagtgatccccatttttctgacggttgtttctaccatccttggctttatcccctttatggtgggagcagagaaagaaggtttctggtttcctttggctgcaggtactatcggtggattggtaatgtccgtgatcggcgtgtttattttcttgccggtactgactttgaataaaaagaagatgatggtgaagaagccttgaagaaataaattagctattagcatatttcgattagctaatagctaatttgtttttgctaatagctaatcgaaataaggtataggagataattcaccagttatttcctgcattgctgctgccgatcagcatttctacccgttgcttatacaagttggctccctcagcgatgttctttcccgcatctgcggttcccattccgtaaacaacaacaggcgtttgccacgacatccccgaatgaatggcactaacctgataaggacgtaaaagctcatccactgtgaagcggtttctgcctccgctacggtatgcttcatattcggaacctgtggtggttactactgtcaatggtttcccggctactgccggagtcttggaaaggaaggtgaatacttcgtcctgccattttttgagcaatgacggcgcagccatccaatgaaagggaaattgataaatgagggcggaagcatcggaaatgattttgctccattcgtcaacatcaaaagaagcgccttgctggtcgtaaagattgaatactgctacgccttcaatatcactcacagcatcaatcagtgctttgtttgcttgtgattccttcatattgggatgcgccaggagaatcaccacttttcttaaatctttattcataatcaatcgggtatttaggatgaaacaactacatctataatataaaggtctaaaaataagaaaaagttttcgaaactcaatatcttaattaaaaataaaagaatctctctttgcttttgaatttgtatttttgcaggcacgtccgtaaggcgttattttagataataaatttatatatgatagatttcacccaatttccttctccttgctatattatggaggaagaactcttgcgaaagaacctgtgtctgataaaaagcgtagccgacagggcaggagtagagattattctcgccttcaagtcattcgccatgtggcgttcatttccgatattccgcgaatacgtggagcattccacagcaagttctgtgtatgaagcgcgtctggcattggaagaatttggaagtaaagcccatacttattctcctgcgtatacggaacaggattttccggaaatcatgcgttgcagcagccacatcacttttaattcaatggcacagttccgtcgtttctatccgatgacagtggccgaaggaagcggaatctcctgcggtatccgtgtgaatcccgaatattcggaagtagaaacagaactttataatccgtgcgcacccggtacccgtttcggaatgaccgccgacttattaccggataccttgcccaaaggaatcgaaggtttccattgtcattgtcactgcgaatcttcttctttcgagctggaacgtactttgcagcatctggaagagaaatactcccgctggttcccgcaaattaaatggctgaatctgggaggcgggcatctgatgacccgaaaagattatgatacagaacatctgattaaattattgcaagacctgaaagcacgatatcctcatttgcagatcatccttgaacccggttctgcttttacatggcagacaggagtcctgacttcggaagtggtagatatcgttgagagtcgcggtatcaagacggctattctgaatgtgagtttcacctgccacatgcccgattgtctggaaatgccttatcagcctgccgttcgtggtgcggagatggggaatgaaggagaatttatttatcgtttgggaggtaattcttgtttgagtggtgattatatgggattatggagtttcgatcatgagttgcagatcggagaacggattgtgttcgaagatatgattcactatactatggtcaagacaaatatgtttaacggaatccatcatcccgccatcgctttgtggacaaaagaagggaaagcggaaatatacaagcaattttcttatgaagactatcgggaccgaatgagttgataatcaaaacaattgtttgtttgcggaaacaaagtgtgcagattcttgtgaaaaaaagatgcagaatgtttgcagaattacggaaaatccctacctttgcaaccgcaaacgaaaaaatgcggaaatagctcagttggtagagcataaccttgccaaggttagggtcgcgagttcgagtctcgttttccgctcatgtttctttgaaatgttggaaataaattttgcccaggtggcggaattggtagacgcgcacgtttcaggtgcgtgtgtcgagaggcatgcaggttcgagtcctgttctgggcacaaaaatacagaatcactatagctttgttcgatttgctatagcgattcttttttatacgggtactttatcgggggcttacgttttttcttctttttgtttttaaatataacaaactgttcctcagaacaggatagttctgttatgttgagtgacgaaaaagaaaagattaagttattcttcttagaagttgaattgatagataatttttcttcttgttgaatggcaatattgttatctgtattgaaaacttgtttttctttcactatattgaatctcttgcttttttcgttcaagctattcaactgtaagctcccgataaagtcctcgtataaattatagaatcgctatatacatctaataagtttatagcgattctctgtttataatatgcttttcattagagtattgttagatttctttggatcttctcagtttccagtaattgggtagcaactcttttaggtcttttcccttatcccttgtgtaatatggcaaccaggcaattatttcggtaagccattctctagggttaacttgagatgctttacatgatgccaataatgaacagatgacatctgtgttttccgccgcttcatgatttccacaaaacaagaagttttttctcgataaagctattgggcggattgcattttcagccagattattatcaattttgagcttgccgtctttgaggtaatttctcatgcgtggccaaagggtataggcataggcaatggcttgtcccatctggcttttaggaagcactttcggataggttgtttccatccattgttccagctcgtcaagaataggaagagcctgtttctgcctttttgacattcgcatttcaggggatattccctgtatgtcggccgcctgctctatccggtagagttcctgtattttggccagaacgtacttagcctgagacttattttcctctttggcggtctcatagtgacgcctgatatggacaaggcaacccacaaggcacaccctttccttaccttcaaagacgttgtaggccgcataaccgtcactttgaagatatcctttaaatggttccaataagttccgtgccgtttcctgtgaacgggaaccgtcatcataatgaaagaatactaatccgctggttaccgccctgaccatccacagatattccctgacagctttgtggctttgcttgttgatgataggcaatgtggtttcatccacctggatgtaatcgactgccaatacctgcttcttgagttcatcatacaaaggctttagcagctcacaggcgggtttgaaccagccatgaagcgtgttttccgggattttcaaacctaagtgatggaactcccgtatctgacggtagaatggaacgtgatactcatacttttgcaggagaatttctgccagcagactggcacccggaagtcccttataaataggcaacagtggaagatcggctattacgataccatcctgatattcctggggtaaagcggtattgtctttcagtccatatttgggacgtatgatttcctttacatataatttacccggttcaaactcaagtgtacgtgtatgttcctcgccaatccgtttatactttgtaagatccaggtcttgcggttctatgacaacttccacaaccggaagtccttccaacagtttacggttctgccgttctttctttttagtaaccataggtgttgtagtttgttcaactacagtttcttccaaaggttccggttctaaggattggaccggctgttcaaacagggatagctgatttgggtctagacgggataacttttcactcttacgaccaaaaagttgtcggttcagccatgctacctgagccagcagttcatccagtttgttttgtaactgttcattctgccgggtcagctgtctgatggactcagactgactggcgttagtctgttggagtgtggctaccaaaagttctaatgtttctgtccgagtcattatttatgaggattttgaacaatacaaaaataagaaaaaactcttacttaaacaaggtctggtccattgagtttcactgttatatatcactttttcgtaacgccttcaatcgcttgagcctcttagcggatccgttattgattcctttcaccatcatgaccagatcacgccactccatggggtatgatctgctttgctgatcatattcgggcaagcggaaggttccttcctccagcctttttatatacaagacaagatcgccatcttccgcatgcagaagtttcatcgtggtccgctgccggtttatgaaaatgaatacgtcacctaaacggacgtcgtagcccatcttgttatgaatgactccacataatgaattcatgcctttgcgcatatctgtcttacccgggcaaaggaaatatcgcatcgtatcattcaggcaaaacatgatgaccgtaaatttgagtgagtaattgcatggcggcatgggattcagccataccactgaagcgggctattatgccaccaggaaactctatttgaatctccccggatcccatagctactctatcataagacgggttggatgtggacggggaggtcaaattgataggagcgaactctccggaagaggatctttccccatgataaggtcgtgagagaccaaactttcctttccaataataaaaactagattcggtataggcttcattgacacagaagtcttttatcgtcaaaccgcttcgttgctgacgggatagaatttctaagaattcttctttgctcatttttcgcataatcttttttacgcaaagatcgagcgaaaaaagatactagacaacgggtactttatcgggggcttaccattttataatagattcaggaatttgtcatcttttgcgaatccgttgttaatccagtaggtggacgattccggcataatcggcgggaatatcatcgatgctgtaattgggcaataccatgaacccaccgcatgacacaacgggagcttttgtcaccgacactgttttaaccacgtacttactctcgatatcaggtccacaaccgtaattcaggtagggagcaatgtacgctccttcccaatcggcaaagtctttgagtagtacaaatagaatctcttgtttcattattcgttgtattttagataatttattttaatcatttataccatgtttatacgggcagacatttcggcattgccagcaacgaagttccaatacaccttttacggtaatatagcaaactttccggcatcctttttgactaaaattgttttcgtctgtgagtgctcccgaaggacaaagatcgacgcataggttgcagttgttgcaaacctggtatgtcgccaatggatcgggctctaattccaacgaggttactactgccgtaaaccaaagcagattcccgtacttatcattggtaagcaggtagttgcgagctataactccaagcccggcaagttcggcagcatgtttaagtgacacacgcgagcggaaatgtccatctacgaatttaccgctaagcgagactatcgacacggctttgtatttgagtcctttgagttcggctgctacatccgcagcaaccttatccatctttttaactgcctcattgcgtatatccgtatatgttcgtatatcctgttcgagaatatctttgggcaaaaccattccaagagagatgaccgacttagccgttggcataacatcggttgggtgatatcctttcggagcatttacaaaccgctcgaccgaggcaactcccaccagatcagctccaaacgagcgacataactttttaatctctttatttgtcattttttgcagttgtattatatcaaataatccccagtgctattgcgataaaactaggaccattgattaccccatgtagaaatactcctgtccatgtgttctgtgtcttttgtaccacataaggctctatatacaatagcggtaataacataacaagtagttgccaaccaaacgctatatgaaaaatagcccaaccagtgccatgtaatatccacgttttgtcttcgaaagtcttttcttgccgaggtaacaacacacctctccaaaagaactcttcgcctccgatattgagcaaccaatatgggaaccatgcaagcaatagccaatatcttcccggtgaaagcggatccaaagtcataaacgacggagtatggttgaaatccgaaaaaaggacttgcatcgcaatcataattccacttgtcaagagtccgattaccaccaacgccagaagtgaataacgccaatctctacgactcataggtctgaatcgtagtcgctccacaaaggtctcttttgtgaatttgcccccttctttgcgaagcgtcatcacgccggcaataataagtggagtgaaaactccaagccctccgcaaataaaccagaagataatggactccaatccggcaacttccgaaagaaacggaatgcataagtgggtcatcaccccccaaaagcatggctgccgatacgaatatcagtgtcgatggcattaatctcaatggtttcatttgtattctattgcttattatttacaaaatttcttatattcaatcgacagaatgtttggcaaagaataatcctttccgattcaaatccaatttcttcatttggagaataatacaagtctcttcgaaaggaacgataatcaagaatggtaatataaaccataggaaagagaagctacccataaaaatataaataaaaggaatacagtatattaataagcctacaattttattcccgatagtatgaattgcaccaagttgataaaacttgctgtaaatacgctataatttgttgggtgtattgaggttgttctcttactgatattgtattcataatgttgtctattatatgttcctttttctatttgcagcaattataactaatgcttgcggcaaaaacagccaaaaaccggaaatcggctctatgatacatccaaccacagcgaacgccaaaatacaataccccaaaatcagaggtgcgggtttctgctcttttttgatatagtattggagtgttagcccccaaagaataagtataatcccacatactaaaaaccaaagggcgaaagcacggctgtaactatcatctgtggagtttattaatccatcttttatcatgtccgtaaagtcttctttcccaagtaatagtgcatatactgtgtggattgctcctgttataacaagaaatgtcccactgtatttccaaagtttcatattttcattcattgtcatagataatattttataaatgtacttttatagtctttattactttctctttttgttatagttctgatggagttgtgtttgccaaatttttagcttcttttacaaaatgggaaaagtcggtatatcccaattcgtcgtataaatcataactaccatttgcacgatagttcttcaatgcagttttaaagcgtaaagctttaaagcattgtttgggtgatatacctaatacttctttgaaatatctattgagtgtaggatttgacaccccaacttccttacttactgtgttcaatttgtaattacggttattattgatatggtaaattgcttttattacagtgttgagtttgaaatcagaactaaagattttcatattacttaaaagccaattctctacaaactgaactcgctcggcaaaagagctttttaattttagttcgtctattactttttgatttagatacttttgcagagacaaatgattatccaccaaagttgaaatatctttagacaaacaggagtacaaaactcccggcttgaattttattgaaaattcatgggttccgggagcgtgtattacagtgatcgcttctgttaagctaccagatatcttatcacccgatgtatcaattataccatgttcacgatgtactttgaatgtctgactactatcggagatataaattgaaactaagatattagcattgggcaaagccacaagtgaaaatggagttatagaattgttaggagtatatatttcaaaataatactcaacaatatcctttaattcaaaacaaggatatttaatctctacctgttcttcatcttcaaatatgactttactctttaccatgtttatttagttaggtgatataatacctgaataccaagcccgaatgtcatcattcgctcttttttgttggttaatagctgttgtgtccaatcaagcaatccaccgtcagcaatttcaatagtattgccgccgatcactatttgctgctttattctgaaaccatggtaatagttattatcatgttccggtgctataaccaagacctcaagattactattctttttccggacatacgatattgattccattataagcgggctttgactgtcataacctttgcatggaataatctcataatatattttctccacaccgtaacttttacatatctcatacgatgtagttaaatgttttaataattcttctttctcaaaattaaagctaccagtatctctaccacatgaaataagggcgagaacagtaaaatgaggagtgaaattaggattattaaatacctgtgtccttattacccgtgaaatgttgctgtaattataggttttgttatctaattctccttttttctttaacgatgcgtaatgtaatgctattgtattcgtcgggtctgcctgtacttctgtgtttcttaaagaagtaaggacttttttctgatctactgttgctataacactatttgtcccaaactgagcgaccggggaaagttctatgggttcaaatcctctacctgctattaatttatagcaccgtaattctttttctttatattctaaaacatcttctaataaggcgggcttaacaagcttgttaccctcatatttacttagtaaagacgagggagtttcctgctgaacacgcttgttaaaaatgtccagtaaaacagtgttcagttccgacccgcttaattcatcggacaacactttagctatatcctgcaaatctaacttactaataaggtgatcgcctatatcttttttcattttttcctaatactatataaatgttcatcaactatttgtccctcttttataactgaggacttaataatggcttccttttcaaaacctgtttttattttgtaatcgtatcattttaatgtacttattgttttttgcaaaggtaatctcatatgtcatattaataagtgtaaaaatgaatcaatctgctaatttttttaatagcctaatcattaatcaaatttgttctaatagttaatcctgaattttatcttttagttctttttttaattctgatggaatatcattccaatgtaagtttaatagagctccttctaaagaatagagataatagcacacaggtatagtcttttcaggatgttgttcacgtatctttataaaagctttgacagatgttgtttctgcaagatcggctaaagtgaatataccaatttcattaaggtatttctcgattgttgcacctatattcttcgcatttcttaaattgttgtctatttttgatttcatttttactatggattacgtaatatatatcttctttctacaaattcggtaatattttatcatttcggcaatacttattctacaatgattcaatagatcgctttaaacatctaatcggtacccaaccttccttggttgaattttcttttcgacaccataaccaaccatttaggtatcttgagccgattactatctcgtcttgatttactggtaactcataagcagaatagtcttctaatgcaatagctatttgccattcattcggtaaggtctcacatacgttcaaaatttgtataggtacccaacctgtcattccattgcccgctatgcaccaaacccaatttacccattctggatcagtttcttttatagctaaattgactacaactttttcatctttctttaatataataggatttttatagctttcaacccatttgcacacaacaatatatttatataaatatttcattatcttgttattaagttgttttcaatagttgcttttatatttttagcgatttattaaatcgctggttatatttaacttcatctttactggttattacataaagtattgacagttgctttatgctatgtaattccatgccgcgaagttaaaacatagagtttttcaaaaataggaaaaatcggacattttattcagcagcgatctttaagggcgttttaccgtaaaataatttaaactcttttatgaaatgagtttggtcatagtaaccaaaatcataatatgatttttcggattttattaatttaactgaagggtcaatctttaaaagattttgaaaacgaacaattcggcaaaaagacttggctgtatctcctatgtaaaaattaaaaagtcgttgtaaatgacgactacttattccatcattcaaatctttctcaataataatcgatcctttgctttttaaaatagtttctaatgcacagaaaaatctattatcaaaaggtttatctattttatttatgtgcttaataaaatagatattgagttcatcgcacaaatcctgaaggcataagcatctatctttcgattgttgaattacattgtatatacaaggttgcacggtatttaaacgttcgtaatggttgcttaattctgacgcatctatattaaatagtgacggaaatatacccggaagaaaccgtattccgaaataattgaattctttatcaatgccaatcttcacaaaagaattgcagtaccccattatatatgtttcatcataatttgtacaattaaaaacgatatcaatacacccatcagcaactacacgataattgtatatatcatctagtggcttaatagtctttagattccaataacaataaataaagtcttgtagttgtgcgtcaggtggcaactcaatatatgagacctcgccattagttcctattactgctggctgtactggagtgtacaggcttcttatgttgtattccaatttcaaattacgagtgctaacttagattattactttatcaactttatatatcggctatctctcactataaatcaaaagctgacatagctttaaaatattcggtgtagaaatctatgcattcctttactttatttgtatggatcgtaattgaaaggtctttgaacttcatgctgactacatttataaattgttgcaatatagtaaaatttggagtgtgctcatgatatttatcatgaagatttaagtgttattggggaaactatcacccaaacaaatcatgtcttatgaaaagaactaatgaagattatccatccttcaatctgttttccattgtcggcacatgggaaagcgttaatctgaatcctacggttatcatctaccggaacggtaaagaatatctcctttctattgtatatgtatcggaaaccaccaagcaggcttcacccgctacttatgagatacagcaagatggtagccagtattttattgccactgcatccaaacggctctctgtagattatgacccggcaaaagatgtacttagcatctcatcattgggggactatctgcgcaactagcctgctatctagagatcttgaaatcaatatttcaataaaacaatctttcagtcatggaactaataaataaagataccctacaaatcaaagaatttatttcttcgctcgattcgatgctggacggcattgaatctattgtaaagcactacaagccacacttgaacggggaacgttttctttctaataatgaggtttccaagaaactgaatgtcagtctacgaaccttgcaggaatggcgagatacggggctaatcccctttatccagataaaaggtaaaatcatctatcgtcaaagtgatattgataagttgctccaaaagcattactttgaaggttggaaagaataacctgctagccctgagaacattttttttcagaatttaatttgaatcattgactttgccagtgaagtatttagtctgtgcaagtttttagatgaaaatacgctcgaatgaaatgagaggaagatttttatccaaagttctcctttattgtcttttagcaagtgttcaggtgataagtctttcacatcgctgaacgccaaaccggtataactgcaaaaaatgaaaacgtctcgtacctgttctactcgtttaattgtgaactctttagcgagaatgattttaatctcgtccattgtcagaaattcaggatatgtttctttcagtttgaaacgatagtaagcgaatggatctttctttatccagtcattttccaaggcaatgcggataatcttctttaagttctttaatcgggtgatagcggagttctgcgcacaacctttttcaatcttcaagaaagcatcgaacttagaaatgaagttggcttccaagttgttcagggcaatatccgataactgatattctttcttaatgaattcctccaaatatcgggtagtggtttcataccgttgaacggttttactaataaagtctttaccgattagcttgcggctttgttcgttatgctccctgaatacctgtaatagcgttttgttatcttcgtccacatcataatacggttttctaacaagatcaacagtgataaccttgccggaagtttccagttctctataaatttgatgtacgtgggaacgtgtgatttctaagtagtggttcggttccaccgacatacggtctttgccttttgaattctctttagcctgattccataggtctacaggacagcttcttttgatagaaatgtctactatacagccatttacggtgattctcatgcatacgagtgcttcaccgttctttaattattctcttccaaagtacgaccatgcaaaaagctatgaatcagcgagaaagatgcaaattcgtgggacttttttcgattaaattttagtcccacgatttatccaccgataatatgcttgaaacggctattttctgctacctgccaaaaaaaagaaatccccgataatacttgattatcagggatttgcttgatttttcttttgttttcagtgatccagctggggctcgaacccaggaccccaacattaaaagtgttgtgctctacctgctgagctactgaatcaatccttatttgcgaatcagttatttcctgattgcgggtgcaaaggtagttacttttatttaatttgcaagtgtttcgtagaaaaaagttccaattatttttcctctttatcgcttgtttcttgattatcagtagtttctacttcatcatattttattctttctttgttgataataaagcgttgatagtaggaaagcatcaaagtagtcagaggcaaggcaatgatcatgcccagcattcccattaatgaaccccatatagaaagggataaaaggatgatggcaggattcagccccgtaatctttcccatgattttggggacgaggaaagtatcctgtataatttggacgatggcgaagactgccagtgcgcatgcaatgataatccagaaattctctcccgtatcggcagctttaaggatcgccaataggaccgtagggaggaaaccgatgatttgcaggtaaggaaccatattaagcgctccaatgaaaagccctagagcgatagccatcggaaaatcgataataaggaagcctatactgaacagaatacccacacaaaaggcaaccagtgcctgaccacggaaataccggttcatgccgtcctgtacatcatgtacgaggttggatgcgaaggtacgatacttgttgggcagcagatgcagccatccttcggctatgacttcataatccagcaatataaagattacatataataatatgataaaggaggcgagaatgctgaacaggatattgagcgactccgcaagcagggcccacactctgggcactgtatctttgatggctgcaagaatattctcttcgcttaatatacggttgagcgcctgaagatcaatattctcatgaatgaattcggaaagattcttgggcacattattcccggctccattggtgaggtaggttaccagtaagtcattcatcctgcctatttccgaaaccatgggaggcaccaacaaatagaataaggatactccgagaagagtaatcagaaacaaggcgcagaagatagaaacaatacggctctttaaccgtagcttatactggaaaaacttgactaacggataaaccatgtaggcgatcagccaggctataaagaaaggtaataacactccgctgagccgttccacaagcattagtatccctaccaccagtacacatccgatggaaccacgtataaaactgtcgaatgttatcttctttctttccatatatgttttaaatagagtttatatcttctgtccgtcctctccccgtgcacggaggtagcacttcctgcaaagcggctcgtattcggctgtctctcctagaagtacctgtttgtcattcttgacggtacgatgagagaaagatgccagatcaccgcacttcacgcagatagcatgaaccttggagacctcgtcggcaatggcacataattgaggcatcggtccgaagggattccctttgaagtccatatccagtccggcgatgatgacacggatgccgttattggcaagctgtctgcatacgtcaatcagtccgtcatcaaagaactgtgcttcgtcgatgccgactacatctatttcagaagtgaacaacaggatactagccgatgaatcgataggggtggacgcgatggaatgactgtcgtgtgataccacgtcttcttccgaataacgggtgtcgatggccggtttgaatatctctacacgctggcgtgcgaacttggctctcttcatcctacgaatcaattcctccgtctttccggagaacattgaaccgcagattacctctattctacctcttcttctggtctcttgtatgtggtcttctgaaaataataccatgtgatttttgtgctttcttgattaaataaatgagtggacaaaggtaaacaattcgatgtacaagaactgttaaattatccattattttaagttattgcataaattattcctacattcgcaccataataacaatggatggaaatgaaacagaagctattaacagatattgagctggatgttcatgagctgaagctactcatgaatacgttttctaaagagccgactcagactttgtctgaactgttgaagcggagcatcctacgtatgcaggagcgtttggaacagttgtcggaagagataagtgctgtgccggtggaagcctcgtcttctcctgtagcggaagcggaaagtgaagttcccattgttgaagaacaagcccctgtaatagaggaaaacgaatatccggtgatagaagaaccggtcgtggaagagaatgaagcgacagcatcgggagaagatgaacctgtgatagtacaggaaacgcagactgctgtggaagaaactgtaatggaggaacctgttgtcgaagacgaaatggaagagaaagaagcggaagatgagtcggaagacgacgaatcgcttctgatagaggagccgaaagctgccgtattgggcgaaagcataaagatggctgccggattacgtcattccatcagcctgaatgattctttccgtttctcacgtgagatattcggcggagaccccgaactgatgaatcgtgttatcgagcagatatcagtcatgagttcttataagactgccgtggcatttcttgcctcgaaagtcagcgtaaacgaagagaatgaggcgatggccgactttctggagttgctaaaaaagtattttaatcaatcagcataaaagtttatgggaaagttatatgtagtacctacgccggtaggaaatctggaggacatgacctttcgggcaatcaaggtgctgaaagaggtcgatctgattttggcagaggatacacgtacttccggtattttgctgaaacactttgaaataaagaatgcaatgcaatctcaccacaaatttaatgaacataaaacggtggaaagtgttgttaatagaataaaggcaggtgaaaccgtggcattgatttcggatgccggaacacccgggatttctgatccgggatttttggtagtccgcgaatgtgtgcgcaacggtatcgaagtgcaatgtttgccgggagcgacagcttttgttccggcattggtagcatcgggactgccgaatgaaaagttctgcttcgaagggttcctccctcagaagaaaggacgacagacacgactgaaggcattggcagaagaacatcgtactatggtgttttatgaatcgcctcaccgcttgttgaaaacgttgacacagtttgccgaatatttcggcactgaacgtcaggcaaccgtgtctcgcgaaatttccaaacttcacgaagaaaccgttcggggaagtttggcggaattgatagaacactttaccgctaccgagccccggggcgagattgtgatagtattagcaggaatagacgattaaaataacttcatttaaaaacgtaaaacgtaaacgtatgaaaaagttagcagttttatttatgtgcgcagccatgttggcttcgtgtgactttaaaggtggaagcaaagaccttaaggctgaaaatgactctcttttaatggaattgacacagcgtaacgctgaattggatgatatgatgggaactttcaatgaagtgcaggaaggattccgtaagatcaatgctgccgaaagccgtgtggacttgcagcgtggtactattaccgaaaattcagccagtgccaagcaacagattgcttctgacattgaattcatctccaagcaaatggaagaaaacaaagctcagattgcaaaactggaagctcagctgaaaaacagcaagtacaactctactcagatgaagaaagctgtagaagctctgactgctgaattgaaagttaaacaacaacgtatcgaagaacttcagactgaactggcatctaagaacattcgtatccaggaactggatgcagctgtcagcgacctgtctgctgccaaagaatctttggctgccgagaacgaagcgaaagctaaaaccgttgccgaacaggataagagtctgaatgccgcatggttcgtattcggaacaaaatcagagttgaaagcccagaagattcttcagagcggtgacgtgctgaagagcgctgatttcaacaaggattattttactcagatcgatatccgtacaacaaaagaaatcaagttgtactccaaacgtgctgagttgttgactactcatccgacaggttcttatgaactggtgaaagatgacaaaggtcagctgactttgaaaattactaatcctgccgaattctggagcgtatccagatacttggttattcaggtaaaataaggtagacatacctggttagaattgccaatgtgctgattcctgaattcaagaaattagcacattggcttttttatttctcatattatatatatcacggagccaatgaaatataaaaatctcttttttgacctggatgacaccatctgggctttctcacgaaatgcacgcgacacctttgaagaagtatatcagaaatattcatttgaccgctattttgactcgttcgatcattattacacactgtatcaacgacgcaataccgaactctggcttgaatatggcgagggaaaggtgacgaaggaggaactgaactgccagcgtttcttttatcccttacaggcagtaggagtggaggatgaggctttggctgaacgtttctcggaagatttctttgccattattcctaccaaaagcggcctgatgccccatgccaaagaagtgttggagtatcttgctccccaatataatctgtatatcctttccaatggtttccgggagctgcagtcgcgtaagatgcgttcggcaggagtagatcgttattttaagaagatcattctttcggaggacctcggcgtattgaagccttggcccgaaatctttcattttgctttatctgccacccagtccgagttacgcgaatcgttaatgatcggtgacagttgggaagctgatatgactggagcgcatggggtagggatgcatcaggctttctataatgtgacggaacgaaccgtctttccttttcagcctacctatcatattcattctctgaaagaattaatgaatttattataggttttatggattaagtcgtatttttgttgcatttaataaatgtataaaatacgataacatcatggatagtacgcttctgccatttgccttactttgttttacttcgttctttacgctgaccaatcctttggggacaatgccggtctttctgaccatgacacacggaatgacagataaggagcggcagactattgtgcgccgtgccaccatcgtgtcgtttataacgttgatggtgtttgtctttgccgggcagttccttttcaaattctttggtatctctaccaatggtttccgtattgccggtggagtaattatctttaagattggttttgatatgcttcaggcacggtatactccgatgaaacttaaagacgaagagattaaaacctatgccgatgacatctccattactcctcttggaattccgatgttgtgtggtcccggggctatcgctaacgccatcgttttgatgcaggactctcatacttacgccatgaaaggtatattgatcggaacaatcgctttgatttatctgctgacgttctttattctccgtgcttccacccgactggtgaaagtactgggagagaccggaaataatgtgatgatgcgtttgatgggattgattctgatggtgattgcagtggaatgctttgtgagtggagcgaagccgatattggcggatattgtgagagaagggctgagcggtatctgcaagtagaagtctgtattgtggggaggaacggataagattacactcatgtgtaaattcggaaatggaaaataaaaagcgagcccgtttaactgcttaaagttaaacgggctcgttattaaaatggtttcagtgtattagtagccttcgttttgtttcagcttaccgttagatacattgatctcggaaaccggaataggcattacagtacgatagtcgtcatagttgatcggaccggccggaacctgagcattcgttactgcctttttgtttctccatgtatcccaggcgttatgaccttcaccataaagttccagtctgcgttctgtcagaatatcatcgatagtaacagaagcaacatcttcatagtcggctattctttgcttacgcaagtcattgatatagctggcaggatcagcaccacctgcttttaatgcagcttctgcggcgatcagatatacttcggataggcggattactttcggattatttacatatatttctccgtcgcgtcccggatacttctggatataccagccttcgttatctccaccgtcgctttcttcagcaatcagagtgctgcgaacatcttccggacgttcttgaaggaaagttttgaatccctcggtgataccggcttcagcataaccttcggcatgtgtgtagaatccgagagagttacgttgtgcattgtagagtgaggtaatcaggaactcgaaaatgctttcactgcttccaactttggtccatactgtttcgtattcatctctggtgtacagcttgtatggagatttttcgattacatatttggcgtcctcaagtgctttactgttctcattcatgtagagatatgcacgggctctcagtgcacgggctccccaatagtcgatatgaccggcagttactaccttgctggtttctgggagattatccaatgcagtcttcaagtcatccagtatggtttcgtaagttttcgcaatagtagctctttctgctgtatatccggattcgaaaacttctgtagacaatacgatacccggatcgctggcctgtgcattacaaggaagtttagcgaacaagcgggccaagtcaaagtggaaaagtgcccgcaaagcatacaattcgcctacctgaacatcaacttcagctccttccagaccggatttcttaactccctccaaaactttgtttattcttgccagagaaagataaaagcgtttgtagaaatagtatgaatcagaactattcttagtagcctggtaggcatatacatcaactgtttgcttattgctaccgatggctttgaagtcgctgcctctttggtcggcgtacaagaagaaatcacctgcgtagctgccacgtggattagttcccgcgtctatagaagaagtctgagactcataaacaccgttaactgcaaactgtaaatcttcgagagtcttaatagcaccttctgaaggccattcactggaaggcactttgtcgaaagtatcgcatgaggatactgccaacgtcagtaatagaatgggtaaatatatttttttcattattcagtctgtttatagattataatttgatattaatgccgaatacacagcttctcaatgccggtgtatctgcctgacgataaccattgatcgctacatccgggtcaatgtttttagtcttcgaccacaacatagccagattgtttgctctgaagtagatgcggaagttggaaatgtgcttcttcaataccggcagagtatatcctactgtcatttctctcagacgaatattgtcagtcgatttgattgtgcggcttgagaatctgtcccaacgataagggttggcatagataggcatcgggttgtctactttatcacccggatttttccagtagtttccggctacatcttctgacaggttcatggaaccgattcttacgccatcatgatgagagaaatatcccggataatcgaacatgtcaccaccaaactggtaagtgatcaggaatgacagatcaaagtctttgtatgtgaaagtgttgctgaatccaccgataacatcaggcaatgcttttcctacaattcccttacctgcttcggagtagtcatttaccactccctttgagtgatcttcaggatctaaccagaattctcccagacctgtttcaggatttacacctttccattcgggcagatagaatgtatacattgactctccctcacggtgcagatacatttctccgtctccatactggatatcttttccttcaggaagtttgtctaccaatgcacgttggtaagtcaggttgaagtttgaagtccatgtaaagttcttgttgctgatatttttagaattgagttccaattcgaaaccatcgttcttcaaagcacccaggttttcccaacgggagtcaaaaccggtgattaatgaagttggtacttcgaacagcaaatccgtagtcttcttattgtaatattccagagacaaatttacgcgatcgtacatattccattcaattcccatattgaagttcttggatttttcccagcttaatttgtcgttagccattcttgaccagtaaatagcgggagcacttccatatccggaacctgtatacaggtccatgtaaccatagtaatctgagggcaagttaccgtttgtaccataagatgctttgatcttgaagtcggtaaataacggcatatcttgcataaatccttctttgctcattctccatgcaccggatacagaccagaaactagcccaacggttgtcttcactcaaacgtgatgaaccatcacggcggaaactggcagaaagataatacttattatcatagttataattgccacttgcaaagtatgacatcatgccggctcccttggttgaacttgcagcctggtccggttgtccgtttgccaattcgggatagtggcttgaataacgtttggcaacagttacaatctgcagcaggtctctgttttcaacttcgaaaccggccatcaagttcagattgtgcatatctttaaaagtatccgtgtagtttaatgtagaagagctggtagctacgcggctttcgaatgtataacgagaacccattccgctgacggaaccaccgttaacgctgttgcgatcccaatattcaaagtgcttgttgtctacatagtcataaccaaagatagagttaagtgataacttatcacagaatttgattgttacatctgcattggtcatgctgcggaacatttttgtctgaatccactccagagctgtatcgctgtctttaccacctagcatcagatgcgggttggtaactttaccccatgctgcatttttattatatgaaccatcttcattctttaccggagcagtcgggtccattgcgaataaaatacctatcggagaagaagtacccattccctgggcctggtctccctggtcgcggaaaccatcttgcgatgtagcggctatcatttgcttgagagctacgttcagccagttatttactttgtgattaacgttcagacgaccggagatacgttcgaagtcactaccaagaacgataccctcgctcttattgtagccaactccggcgtagaactgagtctttgacgaaccaccgttgatagatacctggtgatcttgagtgaaagcagtacgatagatttctttcttccagttcgtatttactttaccggatgggtcatggataaagtcagcgacagtagccggtgagtcgagcagaggaatgaacatatcacctccgttatcgatgttgttcaatgctgcttgtttgctatctgttattccgtaagtaaccagacagttggctaatgattcacgggtgtagtcaatcaagtcggctgatcccatcatattgaaagcatttacagccatcttgttccagcctacttcacctgaatagctgacattcgtttttccttctttacctttctttgtggtaataatgataacgccgtttgcggcacgtgaaccgtacaatgaagcagcagcggcatctttcagaacagtcatgctctcgatgtcttcaggattcagtgtactcaatacgctttgagtcttaccgtagtagttcatgtcgtcatcagcttttgttacaacaccgtcaataacatacaacgggcttttagaagcactgatagaaccgacaccgcgaatgttgatttcggccatagaccctgggtcaccagttgctgaggctgtgcgcacacctgccattttaccggacaatgccttgtcaaaagactctttggaaccggaaacgattttatctgccttaatgacagcagctgatcctgtgaatgaagatttcttcgcagtaccataagccacaacaattacctcatcaagattttgtgcatcggatttcagtgtaactttcaccattggcttgattgccacttcttgtgtttgcataccaatatacgaaatctgcaaagtctttgcagaacttggtacgttcgccaaattaaaattaccatcgatgtctgtgattgtaccttgagtagtaccttttaccaacacagaggctccaacaactggttgcccatcttcttcagaaatcacaacgcctgtgactttctgagtctgagcagttactaggcttatgcccacaaaaaggcatgccaataacagcattaattttcttttcataaattctctcttaaagttcaactttacattaattgtctctatactctaacaagttgcaaaattattaataaatatgaaactaacaattaatttgataaaaaaaggttgtatatataacatattgttatttataacatcgaaaatatgctgataaacatctttatttgctataaatattgtgatttatcaagcgtagaatgtcactttgcgaatgcaaaatgtagtaattaacattctatttgcttgtttttggatataaaactaccctgcaaacgtttctttttgatttattatgaagaaatgacgataaaaaaatagcatttaaattaaagttatgtaaatacttaattattgaattttaatttttgcagaaattaatgcaggttcaaccttaattatagcacagaacttagtttattttgttcttagtattaactaaaagacaatagaatgaagaagattagttacagccttgtgtttaacagaaaaaagaagctgaacaaaaagggaatggcattggtacaagtagaagcttacttaaacaggagaaaaatgtacttctcaaccagggtgtacctcaaaccagaccagtgggacgtaaaacgtagaatggtaaaaaaccatcctaattcagatgcattaaatcgaatgctatatgattttatagccgacattgagcagaaagaactgggattatggcaacagagaagatcaatatccttggattcgttgaaagactctattgaaaaaccggaaaataatgggaattcatttctgaccttttttaaagaggaagtcaacaactcttctttaaaagagagcaccaggcagaatcatctttccactttagaattgctgcaagagtataaaaaggacattgtattcactgatttgacattcgaatttgtgtcttcatttgataattatctacagtccaaggggtatcatctcaataccattgccaagcatatgaagcatttaaaacgatatgtgaatgtggctataaataaagagtatatggatattcagaagtatgctttcagaaaatataaaatcaaaagcatagaagggagtcatacgcacttgtcgccggaagagctgaataaaatggaggaggtgaatctggaagggaagtttacgaagttacaaaaatcaaaggatgcctttttattttgttgttacgccggtttgcggtactctgattttataaatctgactgccgcgaatattgtcgaactccatcaggagacgtggctgatctacaagtccgttaaaacaggtattgatgtgcgccttcctttatatttattatttgaaggtaaaggactgcgggtgttggagaattacaaagacgatttgaacggattcttcagactgaaagataactctaatgtgaataaagacttgaatgcattagctaagctggcagaaatagacaagcggatatcattccatacagcgaggcatacaaacgccaccttattaatatacagtggtgcaaatataacgactgtacaaaagctgctgggacacaaaagtgtgaaaacaactcaggtatatgccaatatcatggacatgactattgtgcatgaccttgagaaagcagcttattctaaattagctaatagaccaaaaggctaggcagtgattgtctggaaatgtcctgtttttaagattggcatcaacagagttgatttaaaatctaacaatatggcagaaataatgcataaatcaatgtaagaatatgcaatttacaaatgatttgtcgcatataaatgactgtaatatacataaaaagtgcaatgtcaggactctttccttttaaaggaacgatccgttcctttaaaaggaacagatcgttactcaccgaggaacatctaattgctttaaaaggaagagccaaaagtagttttaatttctaattttgttctagctgatagactttcctgtcacagggaaatatatcatatcgaaattaaacgtttcttttatattcaaaggtgcaagctgatataactaatcacatagcacaagggaacaaaaaccggacagatgtatttcatccgtagatctgctgttttaaaatcctgccgatttttgtcattctcccaagcaggttctgcatattttgaattataccataactaaatatgcttttcttcagatttgatctttttctactatcacgccaaaaaagtaatcattcattatgattggtggtgagaaatattcgggaaatataaaaatagtatccaataataatacctcatataaataaaataaagacataactttcttataatgaatgaactaaataattgaaatggatagaaacagggtatcattcgttaaagaaaagggtagttataatgctgataaataattgattatcacgtttatatatggatacaataacatatatgacgatcaggtttatatttctcattattataataatcaacacattatataaagaattagttctgcaaagactttgcagatttcgtatattggtatgcaaacacaagaagtcgtaatcaaacctactttgaaagttttgttaaagtctgattctcagaatcttgaagaggtagtggtaacagctatgggtattaagcgatctgaaaaatctttaggttatgcagtatccagtgtaaaaggagatgagataactaaagcgcgtgaaagtaatgtgcttaattcattgtccggtaagattgcaggtttgcaaattgcacagtcgtctggaacggtaggtggtagttcaagtatacagattcgtggtgcttcttctattggcacagtttcttcccctttatttattattgacggacttcctatcgacaatggttcttacaatcctgacagaaccaatggtatagtcgatgtaggtaaccgtgcaggagatatcaactctgacgatattgaatctatcaacgtattgaagggggcagctgcaactgcattgtatggagcacgtgcaaaagacggtgcaattgttattactactaagaaagggaagaagaattcaccggtatttgttacggtaaactcttcaacacgatttgagaatgtacttaaattgcctgatttccagaatgagtatgcacaaggtagctacggagtatataatgtaaaaatgctgaatggatggggaccgaagatttcatcggtacaagatcagcaatttacagattataaaggagataaagtgaccttgaaagcaaatcctgataatgtgaaggatttctatgaaaccggaatgagctatattaataatgtgtcagtagccggaggtggtgaaaaggctgatttccgtttgagctttacttctactaatcagaccggtgttgtgccaggttctgactataacaaatatgcattctctgtgaatgcaggtatgaactttactagcaacttcacaggacgcatctctgcccaatatatacgttcagattctgaaggtcgtccggcacagggggcaaatgatagcaacttgctgattcctttaatcaatggattgccaagaacgattgatattcatgatattaagcagaactggattgatgaaaatggcaaacaggttacgttggatccggaaggcaaaagtaataatccgtactggattattaataagaataaatttaccaataatctggatcgtatgatcggtaatatcacattgacttataagccgattgaaggattgactatcactaacaatgccggaactgacttctatacagaaggaagacgtaaactttacgcaaagggtactgtaggagccttaaatggtaagtttcagacttggaatttgtataaaagaattataaataatgacttaatggtttcctatgagaagacttttgccaatgattatcattttaaggcgatggtaggtcataatctctatcaggaagaatggaagaatgaaaatgtacaagctcagaacctggtagttgacggattgtatacatatactaatgcgaaatctactactccggtgaattattatgaaaagaaacgtcttgtcggtttatacggagatattagcttgggatacaaagatatgctttttattaatgtaacaggacgtaatgactggtcgtctactctgcctattaataaccgttcttatttctatccatctatcagcggtagctttattttcacagaattgatggagaataaagacatcctgaattacggtaagattcgtttaagttatgcgaatgtgggtagtgacgaagatccgtacaatttggcatttaaatatactccagctagtacttactttttgcaatatctgggtaatgtcaatactttcccacacatgggactggttggttttaccgggcctcgtgttctgccgaatgaaaacttgaaacctcagaaccaaagttcattcgaagtcggagctgatttacgtttttttggtggaaagattcgtttggatatgacttattatagcaatatcacaaagaatcagattgtaagtattgatgtcccgttatcaacaggttactttgctaataatatcaatgccggaaagattgccaataagggtgtcgaagtaactttgggcttgactcctgtagaaacacgtaacttaaaatgggacttggatgcaacgtttgcttctaataagcagactgtagaagagttggctgaaggacttgatgaatatacattgactagcggattgagtggtttgcagattaaggctgccaaaggtgattcgttcggtttgtacggtactgcctggaagcgtgatgatcaaggtaattatgtaatcaactctaagacaggtttgagagaaacagtcaataacgtacgtttgggagacgtttatcctgactttacaatgggtatcaacaatacacttacttataaagggctgacttttagtttcttgattgatatccgtcatggaggttccttatattcggaaacagtagctaatttgagaagcagtggtttggctgcagaaacagtggctcaccgtgaagatgcctcttttattgaaccgggtgttattcttcaggatgacggaacttacagacctaatgatgttccggtgaagagtatgcaggactactggcagcatgtggcgaactccagtaataatgaaggaaatatctataatgcatcatttgtgaaacttagagaagtgcaattgtcctatagttttccgcgtaaatggtttaagagtttctttgttaaatcattggatttaggcttcgaggcacgtaacttatggatcatcaaagatcatgtgccgcatattgatccggaagctaacttcttcggtccttctcagatcggaggcggtgtagagtttaacagtatcccttctaccagaagtttcggatttaatctcagactaacattgtaagaattaaacgaacatgattatgaaaaagaaaatattagcatatgcattgagcgctttgacatgtgggttatttacttcatgcagcgactggcttgatatcaaccatgaccccaatactgccgagaaagttgatcccggatatttgtttaactatgtagccgtaaactgggccggaacacgtaccggtggtgacttctatattccgttatcaatgagttcacagtgtcaggttgatggtggacttgattatggtggctgggatgaatcggtatataccatttccccttatagtacaggaaatacgtggaaacattactactctgtcggtggtaataacttgatgctggctattaaaaatgcggaagaagcagatccggtgaatcacaatgctattgcacagtgtaagattctgttggctgaacatatgtatgaagcgacgatgctatggggggatatccctttcactgaatcttggaacggaacaattaagtatccgaaatttgattctcaggaaagtgtattgaatggggtgttgtcattgcttgatgaagcactgcagatcatggatttgaatgatgccaatgcgattgatgaatacgatatctattataaaggtgatatgaataaatggatgactttggccaaatctttaaagttcagaacactgatggttatggtggacaaagatccttctaaagctactgccattggtacgttgttacaggctggaggcatggtatcatcagcatcagataatttggtgttcccttattctgcagaaccgggtaaccagaatcctaagtatgaacttatagaattggttggcggtacacagatattgttttttgccagcaactatatgctgaagccgatgcaggaacgtaatgacccccgtattccttgttattttgaaccgggtgccgacggtgtatatagaggcttaggtaaccgtgaacctgctgttactgatgacaaagataatatgttatcatctgttgtgagcagttatcttttcagaaaagatgcaccggagttaatatactcttgccaggagcagttgcttctggaagcggaagcttatgcgcgcggtttgggagttgctcagaatttgtcgaaggctaatgaattgtataagaaaggcattcgggaagcatgtgcattttatggagtagcggaagcggatattgatacatatgttacaggtttgccggaattgacagcgctgactcaggagaaagcactgtatgagattcatatgcagcagtggattgatttaatggatcgtccgtttgaggagtttgtacagtggagacgttctggtactgctggaaatgaagtcccgaccttacaagtgccggaagatgcaacttcaaaagaactgatcagaagatgggagtatagcccggaagagatgactgctaatatcaatgcaccgaaagaatctccgaagatttgggaaaagttatggtttgatttataattgaattactataaatggttacgaaaaagaggacaatacaacattgtcctctttttttttgttatatttgcgaccatatttagatttatatagtagaagttaaagaatgaaagaatttataatatccgaagccaaagtagaaaccgcagtacttgtcggactcattacccagatgcaggatgagcggaaaacgaacgagtatctggatgaattggctttccttgctgagacggctggggcggaggtagtgaaacgatttacacagaaattaccgacagccaattcggttacttatgtcggaaaaggaaaactggaagagatcagacaatatatacggacagaagaggaagaagaacgtgaagtgggaatggtcatctttgacgatgaactttccgcgaaacaaatacgtaacattgaagccgaactgaaagtaaagatactagaccgtacttcattgatcctcgatatatttgcgatgcgtgcacagactgccaatgcgaaaacgcaggtggaactggctcagtacaaatacatgttaccgcgtttgcaacgactctggacccacttggaacgtcagggtggtggctccggtagcggaagcggtaaaggaggttctgtgggacttcgcggaccgggtgaaacgcagctcgaaatggaccgccgtatcatcctcaaccgtatgtcactgttgaaagaacgtctggcggaaatagacaaacagaaagccactcagcgcaagaatcgcggacgtatgatccgtgtcgcattggtcggctatacaaacgttggaaaatcgaccatcatgaacttgctgtcaaagagcgaagtgtttgccgaaaacaagctgttcgctacgcttgatacaacggtacgcaaagtgatcatcgataacctgccatttcttctgtcggacacggtcggatttatccgtaagttgcccactgacctggtagactcattcaaatcgactttggatgaggtgcgtgaagccgatttactggtgcatgtagtagacatctctcaccccggatttgaagaacagatcgaagtggtgaacaagacacttgccgacattggcggcggtggcaaacccatgatacttatattcaataaaatagacgcctacacctacgtggagaaagcgccggacgaccttaccccccgaacaaaggaaaacttaacactcgaagaactgatgaagacgtggatggcaaagatggaagacaactgcctctttatttccgcccgcgaacgaatcaatatagacgaactgaaagatgtagtttatcagcgagtgaaagaattgcatgttcaaaagtacccctataacgattttctttatcagacttacgaagaggaagaataataatcaatgtaccgcttactgattgggggaggcggtacatatctatttttatctatatgaaagactatcgtaaattgactgaggacgaagtgcttcagttgaagagccagtcgtgtctggctgatgattggggaaatgttttggttgccgaggggtttaactgtgagtatgttcaccatacccgcttttcgggtgaagtgaaattaggcgtatttgatgccgaatttacactgcccggagggatcagaaaacattcgggactccgtcatgtaactctgcacaatgtggtagtgggggataactgctgcattgaaaacattcaaaactacattgctaattatgaaatcggaaatgataccttcattgaaaatgtggatatcattttggtagacgggctaagcacctttggtaatggggtggaagcgacagtgctcaatgaaacgggcggacgtgaagtgctgatcaatgataaattgtcggcacaccaggcatacatacttgcattgtatcgtcaccgtccggaactgattaatcgcatgaaggcgattgccgattattattccaacaagcatgcttctgcggtaggtagtataggtgatcatgtgatgattctgaacacagggtctatcaagaatgtacggatcggtgattattgccatatctgcggtacttgccgtttgacaaacggtagcgtcaacagtaatgtgacagcgccagtgcatatcgggcatggagtaatatgtgatgatttcattatctcttctggttccgaagtagatgacggaacgatgctgacccgttgttttgtcggtcagtcttgcaaactgggacataactattcagcctccgattccttgtttttcagtaactgccagggagagaacggggaggcatgcgccatctttgcgggacctttcacggtgactcaccacaaatcgactttattgattgccggtatgttctcgtttatgaatgcgggatcgggatcgaatcagagcaaccatatgtataaactggggcctatccatcagggaaccatggaaagaggagccaaaacgacctccgactcctatatcttatggccggcacgtgtcggagccttttctctggtaatgggacgccacgttaatcatgccgatacctccaatcttcctttctcttatctgatcgagcaacggaacacgacttatctggttccgggagtgaatctgagaagtgtgggtaccattcgcgatgctcagaagtggccgaaacgtgacaagcggaaagacccgaaccgattggattatatcaattataatcttctgagtccatacaccattcagaaaatgttcaagggacgttctattctgaaagagcttaagcgggtatccggcgaaacatccgaaatctattcctatcagagcgcaaagatcaagaactcctctttaaataatggtatccgtttttatgagatcgctattcataagtttttgggtaactccatcataaaacgcctggaaggcattaatttccagagtaacgaagaaatacgtcagcgtctgaaaccggacacggaaatcggaaccagcgaatgggtggatatgtccggactgatcgctcctaagagtgaaatagaccgtctgctcgatggcatcgaaaatggttctgtcaatcggttaaagtccatcaacgccagctttgcggaaatgcatgagaattattatacgtatgaatggacctgggcttacaacaagattcaggagttttacggcttgaatccggacgaaataacggcacaggacataatccgtatcgtaaaagcgtggaaagaggcggtagtcggtcttgataaaatggtatatgatgatgcccgtaaagagttctcgctgtcttcgatgacaggattcggagccgatggttctcacgatgaaatgaagcaggacttcgaacaagtacgtggtgattttgaaagtaacacgtttgtgacggctgtcttgaagcatattgaggacaaaactgcgcttggcaatgaattgatcaaaagaatcgggtccattcaagagtaaaatctaaagtcggcttattggttagtcgcctcattaacagtagttattgtgatctaaagttctcagaccattctcatctcgatgagaaaaaattctcaccacaatgagaaaattttctcatcgcagtgagaaaaaatactcataggcatgagaaaaagttctcactgcaatgagaataaattcttgttgcggtgggcatagttcctttctgcgttattcattcttaattcttcattcttccgttatcattctttatttttaattactacctttgcctcactaactaacattacgtaataaaataagaaattatggcaacacctccgtttaagtatcaacccatgtttgaaaagggaaaagataccactgagtattatctgcttacaaaagactatgtatcggtaagcgagtttgaaggaaatcctatcctgaaaattgagaaagaaggcttgactgcgatggcaaatgcagcttttcgtgatgtgtcattcatgcttcgccgttcgcacaatgaacaggttgctaagattctgagtgatccggaagccagcgagaacgataagtacgtagcactgactttcctgcgtaatgcggaagtggctgccaaaggtgtacttccattctgtcaggataccggtactgctattatccacggtgaaaagggacagcaagtgtggaccggctataccgacgaggaagctctgtcactgggtgtttacaaaacatataccgaagaaaacctgcgttactctcagaatgcgcctctgaatatgtatgatgaggtaaatacaaaatgtaacctgcctgcacagattgacatcgaagctaccgaagggatggaatatgaattcctctgcgtaacgaaaggtggtggttctgccaacaaaacatatctgtatcaggaaacaaaagcaattttgaaccccggtacactggttccgttcctggtggaaaaaatgaagactctgggaactgccgcttgtcctccttatcatatcgcttttgtgatcggcggtacttctgctgagaagaacctgctgacagtgaaactggcgtctactcacttctacgataatctgccgactacgggaaatgaatttggccgtgctttccgtgatatcgaactggaaaaacaagtactggaagaagctcataagatcggtctgggtgcacaatttggcggtaaatatctggcacatgatgttcgtatcattcgtctgcctcgtcacggtgcttcttgtccggtaggtctgggcgtgtcttgttctgccgaccgtaacatcaaatgtaaaatcaataaagatggtatctggattgagaaactggattcaaatccgggtagcctgattccggcagaattgcgtcaggccggtgaaggtgatgtagtgaagattgatctgaaccgtccgatggctgagattctgaaagaactgaccaaatatcctgtatctactcgtctgtcactgaacggtactatcatcgttggccgtgatatcgctcacgctaaactgaaagaacgtctggatcgtggagaagatttgcctcagtatatcaaggatcatcctatttactatgctggtccggccaagactccggctggtatggcttgcggttcaatgggcccgacaactgccggacgtatggactcgtatgttgagctgttccagagccacggtggcagcatggttatgttggcgaaaggtaaccgtagccagcaggttacagatgcttgtcagaaatatggcggcttctatctgggttctatcggcggaccggctgcaatccttgctcagaacaacatcaagagcattgagtgcgtagaatatccggaactgggcatggaagcaatctggaaaattgaagtggaagatttcccggcatttattctggtagatgacaaaggaaatgacttcttcaaacagattaaaccacgttgtgccaaataacaaataacaagtaataagtaacaagtaataagtaatggcaagttattcttgcggttgattacataaacattcatttgggatacctgtcagttttcgtatgggtatccctttttttataaacttgcttatctaataattaaaacaccatgaaaccacctgtgatgaatttatccaatcaaaagaaccagcatattgtctggctggatgtcgttcgttttattgcgatgtttacagttgtctgctgtcattgcaccgatccgtttaatttttatcccggcacggctccgaatatcggagaaataaaactttggggtgctatctacggatctgtactgcgtccgtgtgtgcctctgtttgtgatgattaccggtgcattgcttctgcctgtaagaggtgatgcttctactttttacaagaaacgtattccccgcgtcttttatccgttcctgatatggtcggtgctctataatctgttcccttggattacaggcctgttgggactgaatcctcagattattcttgatttcttcccgtatgcgggagaggaagtgatgcggcagtcattctctgtatctttggaatatattttgatgattccgttcaacttctccatcttagccgtgcatatgtggtatatttatctgctaatcgggctgtatctgtatttgccggttttctcagcttgggtagagaaggcttcggaacgtgccaaactgatgttcctgctggcttggggggtaactttgctgcttccttattattatcagtttgtttctaattatttatggggaacctgttcatggaactcttttggaatgctgtatgcttttgccggtttcaatggctatctgttgttgggacattatctgaagaatctggaatggagcttgaaaaaaacgttgacgattggcattccgatgtttgcagtcggttatgcggtgacattcttaggtttcagacatataaccgcattgccggaatatacggatgagatgctggaactcttctttacgtattgttctcttaatgttgtaatgatgacgatacctgtgtttatgttggcaaagaaagtgaaagtgaactcggaaaggatgaaaaaggcattggcgaatctcactgtatgcggattcggtatttatatgatacattatttctttacagggccgtcggtcgtgctgatgagagctattgatatgccgattggtttgcagatacctgtagccgctattcttgctttcgctgtttcatggggattggtatggctgatctatcgtgcgggaaaggttgctaaatatatagtaggatagtcatagaaaatagaaataggtaagaggttatcaaaagtcaatagtaactaaactccttcaggaaggaggagagtttagttactattgacttttgacatcccctcttatcgcatcctccggtattatttcctatttaattcctttttccatttctcatattttgccagtactttgttgccgtctttattgtaccagctatatccgttccggcgttcatgtccgatttctgagatatcgtattttttaattccgtcgcggtcggagaagaaaggacgattggtgtccagttcataaaaacgtgcccatagtacggggcaatcctcgcaagggatcatccgataatctctttttccgtcactgttggtgaagtattctttttgtactccttttatttcggacttcttgaaccatttgacggctgattctatcgattcaattactttttccgatggatgggggagagacatcagcagaagcacgatattgtcagattcttgtccgctcaatgaaggcaactcatatgcacgtgccttgcagggctccagtgtgatgcggtcatgctgtgcacaccatactgtcagttccccgttttggcgaacctgtgtccggaggatacattctattcctttgtcaaaggctttacgtgcttgctggcaggtttcatcggggatgaaggtataaggggactgcttctcgtagatttcccgtaactgctgcatgactctgaccattgcgttgtcattgtatgtgatttggacatagtatcctgtaggacgcggatagaactgaggccatccaccgttgtcatattgtgctttgagcagatattggatacctttcagtactccttctttgtatttctctttttgtgtagcttgataaagacgggccagatattggatttcagttgtcgtggcattgttgtcaatggtactttggttgacgtcttctttcgcattccttgctttggcatattcctgctcagtcagttctgccggcatatagatgtttttgggccagcctccggtgacttgctggtatagcaatacattgtctccaatgcgttgtgcttcttctgtccggaaaaaggcatcatcgaacttgggagcgaggtgtacccattctttgtaattctgttgtttcctgtaatctgttgcttgggctgaaattccagtctgaatgaaaagtaacagaaagaaaaaggctgtttgtctcatgacttctattgttaagtgaatgttatggtgcgtgcaaatgtagaagaaaaggtcgggaatgaagggtaatatctgttctttatggcataaaaattgggctaatcgcttttatcagatgattagcccaatgaaaacaggagaataaaagtcttattgctccagatatttggtgatttttccgctgatttgcagtagtgatatctcgcaaagtttggtgttgtattctgccgagagaatacgttcttcggcatccagcagactcttttgtgcctcgcgtacttcaaaaccggaaaggtctccctgtatataacggtccatggcgatatcatgattgtctttggcggtcacaagattctgccgttccagattcagcagctgaagattgttacggtatgcttgccacaagttgctgagatcggaacgaagggctaactccagttcctgtcgttccagacgacgattcttgaaggcaagggttgcgttgcgcttttcacggcggcggttgccgtcgaagatattaaaaccgacagtaaccccggcattaaagcctaagttgcctcttctgctgtttgcattgatatcgtatttattaaaggtatatccatagccggtattcagtttgaggtatgggtagttgcgggagttgatctttttgtaatccagctgtgccagtacagtgttctggtcggctttcagcaaagaagcattggtggataaggtagcattccataaatcgtcgaacagtaagtcactgtgtacgtcaatggtagaatctttgatgacgataatctgatttacattattgttggccatcaattcattaagttggatgcgcgaggagtgcagcaattcctgttgcttgatgtattgggcgctgtccgcattgaagtccactttggcttgctgataatccagacccgagaatttaccgacaagatggcttgcttctgctatacgcaggcgttctttggaaagtgacatcgcataatgaaagttcttcagacggatcttttgttggatgaagttgtagtattccgaggcaagatcggcgatgaagtcttcaatggcaatgcgggtgttggtttcgccctgccgttccagttcttttagctgcttgtacgtagtgctgatgttgaatccgtcgaagatggtccagttgaggttgaggccgacgttaactgtctggtcgtagactccattatttttggtgacctctccggtggcacgggctttcgtctcgatattgtccaggtttccggtatatccggcagaaaagtccagggtaggcagataacccgcatttccgagtgtcgcgttattcttgctgatctgttcttcgttatggacgatgcgcagagaataattgttttgcagcccttcttccaggcagtctcttaaggaatagattcgctgtgccttcgcagtagaaactgatacgaagacacatgcggtaactatatatatgattcgtttcatgcaaatacctttctgtttcattcttttgttattttgattcggttagtcgaaatataactgtagatggccggcacaatatacatcgtaagcagtgtggaaacaaccataccacctactacagccgtacccatggcgatacgctgattggcgccttctccgctggcaaatgccaatggaataagtcccagtacagtagaagcgcttgtcattaaaatcgggcgcagacgctgtaatgcggcatctttgatggcactcatcttatcctcgcctgcttcttgtttctgattggcgaattccacgatcaggataccgtttttagccacgagaccaatcagcatgataataccgatctgactgaaaatattcattgtgatatctccgaaatacatgaataccaaggctccggcaatagccaaaggcactgttaacatgataattaacgggtccttgaaactttcaaactgtgctgccaggatcagataaatcagaaggatagccagtataaaagcaaacatcaggctcgaagaactttcacggtattccttggagtctccggataatgcggtacggaaagtatcgtccaatgtttccttggcaatcttatccatttcatccagtccttgtccgatggtctttccgtcagccagtccggcggaaattgtggctgatacaaatcggttgtaacggtacagtttgggaggggcgataccgttttccagttcaatcagattgtccagctgtatcatatctccattgctgctacggatatagatagctttcagatcggcaggcttgtttcgttgctggcggttgatttcacctaaaatttcatactgctttccgttcatatagaaatatcccatacgctggccgctcaatccgtattgcagcgtttgggcgatatttttagtactgactcccattacgctcgctttgtcacggttgattctgatacgggcttccggtttactgaacttcaagtctacgtctgccatctggaaaaccggattctcatatactttggccatgaactgcggtaatacctcctgcagcttttccagattggtagcctggagtacgtattgaacaggcatacttccccggcgtccgccgaaagaagactgctgttgtacgaacgagcgtgccatggtctttttctgtacggcctttgatatcttttccgcaacttccatctgcgtgtagtcacggtctttcatgtctttcagtgtaatgcgtacgtttccgctaccactggatacacgtgctgttaccgcttccgcatccggtagaatagaatctacaagctggttgatatcttcggtatagtcacggatatattcataagtgacaccttctgcacctcgggtgttgatagagatttgcgaccggtcttcaagtggagccatttctgccggaatagcattccataagaaaccgatcaggcagatggttataaaagtgaacggaagtgctagccagcgcttacgcaaaaaagcagcgagcgaacggctgtaccatcggttcatcccttcaaaaaacggttccgtcttagtgtagaaccagttttgtttttcacgtttgatgagtaacttcgtggccagcatcggagtgaaagtcagtgccgcaaatgaagagataatgacagaacccgaaattacaatactgaattcccggaacaaacgtcctgtcataccttgcatgaagacaatcgggaagaatactgcaaccagtgtgatggtcgttgaaataacggcaaagaagatctctttggctccttctattcccgcttctttcggactcattcctttttcgatacggatatagatgttctccgtcattacgatggcgtcatccaccaccagtcccacggccagcacaatggcaagcatggaaagtacgttaatggagaatccggcaagatacatgacgaagaatgctccaatcagcgatacgggaattacgatgcacggaaccagcgtcacccgccagtcgcgtaagaaaaggaagatgatgatgataaccagaataaaggctacatatacagtctcttttacctcattgatagatgcccggataaatttggtattatcaaaaccatagctatacgtcacatcttccggcaggtccttcttcatctgttccatgcgtttgtacacagcatcggcaatttcgatgtgattggctcccggctgtggaataacaacaacacctaccatgggtacaccgttcattttcatgtaactcttgatgtcggcaggaccaagttctgcacgtccgatgtcactgaaacggacgatacggttgttatcttcttttacaataagattattgaactcatcggcagtatgcattaatcccaatgtacggattgtcagttcggtagtgtttccttcaatactacccgaaggaagttcgacattctcattgtctaccgcattctttacatcaatcggagtgatgccatatcctgccatcttgaccggatcgagccaaaggcgcatggaataacgcttttcaccccaaatagatacactacttacatcagagatggtctgtaactgctctttgacagtcaagtctgcaatctcacttaattcaagcagtgagcgtttgtcgctttggagggcaaccattaaaataggcatcgcatcggcatcggcttttgatacagtcggcgggtcacagtcccggggcagataacgttgggcacgggaaactttgtcacgtacgtcatttgctgcagtttccagatcgactgaaagttcaaattctaccgtaatacggctttgtccctgctggctgacgctggatagagaccggatgcccgggataccattgatattttgttccagtggctcggttatctggttctcaatgacgtcggcattggctcccggataagaacaactgacagaaatgatcgggttgtccaccgatggatattcacggacacccagataactgtatccgataaatccaaaaaggagaataatgattgtcagtaccgtagctaataccggacggcgtatacttaattcagatatattcataaggcatggcaggtattagtcaatattatccaatgtaacaggaagtcccaggcgaagttgcagtgttcctgatgtaagaatggtatctcctacttgaagtcctcttacaatttgtacttcagcatctgtacgaatgcctgttgtcacttctacaggttcggcttttcctgatttatacaagaaaactttatcctttcccatctccggtacgatagcttccgtcggaatggcaatcgcattcgggatttcttctttctttaattggatacttgtatatcggccgggaagtaaggcgcgattggtatttggataaagtgcgcgtgctgtaaattgatgcaggttgggatcaatcgttgattctacagcatatacttttgcgctgaaggcatctagttttccttcaattctaaaattcaggttcgtacctttcttaatctggcttgcatagcgttccggtactgaaaattctactttcagcggagtaatctttgtcagtttggcaacgatagttgtcggcgaagcgtatgaaccgacactgatttgccgaagtccgatgattccgtcaaatggagcacggagctcggttagggcaatgttcgcttttactatttctatatcagcatttagagttgccaggtcagtctttacttgttcataagcttctttactgactgcatctcgtttaagcagagcatcttgtcggaatacacggtcctcagctaactttagttgtgaaaccaaccgttgaagttgtgcttgtagctggcggtcgttgactttggcaagaagttgtcctttttttacgggagttccttcttcgaagttgatctctattactttcccggaagtctcaaaagacaaatcaacttcttcatccggcagaagtacgccggtagtagtgtattcgtctgttaacagttgaggctttattactttggcgttgacgttcagaatcttttttccattcttttgggtattttttaccttgtcagcagcagccagttcgtcgttagtttttggtaactgtgagtaaattcccccaccgataattccggcaccgataagaataatgatgccccatttagtttttttattcatggtttagtatagtatatagcatgttatataatatcttctgatgattagacgacacttgaaagaaaaggtttaatgctggataaagtaaaagaaagttaatgttgtgtctggctttaataacagacaaaaggagaatttcgacttttcatctaatttacttatttaaattagtgagattttgcttgaagtttaaattaaaatcaaagttgtgtttgttgtttgaattttggaatcagaatgttcgattgttgtcgtttttttaatagaaattagatttattttttatgtgtaatttcttgctgattagttaagagattagtatgccgcccgatactttccctcctccttatcctccagcatattcagataagaagtataacgagactcactgataagatgcttttccactgcctcacgtaccgcacatcccggctcatgccgatgtgtacagttaccatatttgcaatcagcggaaaccttgaatatttcagggaaataatgcccgatttcttcttcctccatatcgaacgttccgaatcctttgattcccggagtatcgataatatatccatccccgtctacagagaacatttcagagaaggtagtcgtatgcatacctttgttgtgataggtcgatatctcaccggtttttactttggttcccggtaaaatggcgttgatgagcgtcgattttccaactcccgaatgaccggagaaaagtgtgatcttgccttccaggtcttttttgatggcatccactccggttccttccttggcagaaaccttgaaacaaggataaccgatatgcgtatacagattaataagagcgtccagataacggagctcatcctcgttataagcatctaccttattaaataccagtttgacaggtacacgatatgcttcggcagaagcgagaaaacggtcgataaaaatggtggatgtttcgggatagttgacagtaaccactaacatacattgatcgaggttagcggcaagaatgtgagattgtttggaaagattggaagaacggcggatgatgtagttctttctgtcttctatttcattgataaaggcagtaccttcctgattgagtataatctgaacgcggtcgcccacggctaccggattggtgctgcgaataccttttaaccggaaattacctttgattttacattcaataaattgtccgtcgtcggtcttcacctgataccaactgcccgtgttcttgattactaatcccttcatttatttaatggataatggagaatggataatggagaatgggcaatgggactgcatagtaattatccattgtccattctccattttccattaaaccgtcatgatttctttatccttgtcagcaagcatatcttcaatctgtttgatatacttatcatggattttttgtaacttggcttccgcattcttctgctcgtcttctgccagtccgtcttttactgcttttttcagtgcgtcgatgccatcgcgacgagcgttgcgtacacttactttggcagtttcgccttccgctttacactgtttagcgagctgtctacgacgttcttccgtcagaggaggaataccaatacggattacttcaccattattttcgggcataatgccaaggtcagagtcgataatggctttttcgatggcacggaacatacttttgtcccacggtttgatggtgatactgcgagcatccggagtggataaagcagctacattgctgataggaaccatacttccgtaagagtctacgcggataccatccaacagtcgggtactcgcttttccagcgcggatatgtgccaatgcttcttcgagatacattacagccatatccattttttcttgtgcattgtcaaggcaagtctttacgtctaccatattttttgataattaaagttgctatttggttgattgattagcaaaagtatactattttttgcttatctgcaacagcacactcatcttttttataagcgacttgccgatgataatcaatgtaacggcagtgataatcattaaaataccgaccattaatcggggagtcagtttttcgtgaaacaggaggaccccgaaaaataacgctgtcacaggctccagagcaccgagtatagcagtaggagtggagcctatagattgaatggctaatgcggtgcaaatcaatgacacggcagtggggagaatggccaaggccagaacatctgcccacaataagggagagggtatgatttgcaattccgtgcagaaattcaagcggactatgtaaaccgataatccgaataatatagcataaaaagtcagtttggtagtcggtaatgtttttaatgaagaccggttgactcctacgatataaatggcataggagagagacgacagtaaaacaaagataattcctacggtggagagtggtttgttgccatctccctgatagagcagggcaatgcccgaaagtgccaacaggatcgaaaaaacggtgattgcggaaatcttctctttgaaaaaggcgcccatgatcacagctaccatcaccggataaacgaacagaatggtagaagcaataccggcatccatatagttgtaactcatgaatagaagcagagatgaaaacgaaaacagcaatcccatgattaccaaggggagaatgtctgccttgcgaagagtaaaagactgcccttgcagcttcatcaagacacccaatacaattacggcaaatgcgtaacggtagaataaaacagtatcgacactcatgccggcagcatagagcgggagtgtgaagagaggattcataccgtagcttgcagcggcaatggctccataaataaaacctttggtcttgttattcattattttagcctcttaaaaatggcgtgcaaaagtacgtagtttgccgatgataaacaatagtttagggcgttgatagtataatttaatttttcgtatgcgacggattacttggagaatagcatgagattactcttctgctagccgtaaactaacattgtttatgcttgaatttattcgtctgacagctgttttcttttcgtctgacagctgttagacgaaagattaacagttgtcagacgaaagttcaacaactgtcagacgaatagttttatgcaatgcgagacttagattttagcactatagccattaagaaatagtattgaaagctgtaaatcttagtctttttattatctttgcatcaatgacatgccttgcatcttaatacattagataaatacagaatataaaatatgaaagaaaataaactggattacatccccgaaccgatggacctttcattggttgaccttcccgaatctttaatccaattatcagagcgcatcgctgaaaatgtacatgaagtgtgggcaaaagcccgtatagatgaaggctggacatatggcgaaaaacgcgatgatatccataaaaagcatccttgtctggtaccttatgatgagttgccggaagaagaaaaagagtacgaccggaatacggctatgaatacgatcaagatggtgaagaaattaggtttcagaatagaaaaggaggattaagttatgaatgctcgttggtttgaccggattatttatggcggggcttggaaacagatacgtttcctgattattatagtcgtttcgctgattgttttatcttgtttgggagtgcactggggaagcaagtatcagatgactccttcggaagagatgactgtgctggctactgactctgcggcgaaccattcttttcagaagaccctgtggaatgtatacaataactttgttgattcgggcaacctgatcagcataagtccggaagaccgcccgtgggcattgattattagtttgctgggttccgtcgttttgggcggattgttgatctccacgctttccaatatcattgaaaggcgggtggaaaattgcagaaacgggttgattcattataaactatctgatcattttgtgatcatcggtgcagatgcaatgttaccctgtctgatacgacagttatgccaacgggagaaggattgcacgttagtcattcagacttccaaagacgtcaatgaagtacggatggaattattttccaatctcacaaaggatgaggagaagagaatcgttttggttcatgccatgagagactctaaagaagaactgaaaaagttgtatgtggcggatgcgaaagaagtctttatattgggagatagcggagagctggatgatgtggaatattatcatgactcgatgaatgtcgactgtctgaatctgataggcgaactttgcaaggaagagaatcggaaacctcctttgaagtgcaacgtactctttgaatatcaatctacttttgctgtcttccaattctcggatattgatgatgatataaaggaatatattgatttctgtccgtttaacttttacgaaacatgggcgcaaaaagtatttgtgcgaaatgcgtgtagtatccgtgagattaattatctgcctctggattatcagcctgtcacttacgaatcagagaaatatgtgcatctggtaattgtgggaatgtcgaggatgggaattgctctggctgtcgaggctgcccatatagcccactatcccaactttatccgggataaaaagaagaaaacgcgcatcacttttatcgataatgaagcaatgcgtgagatgaacagcttcaaacaagcgtatgaaaacctgtttgatgtatcttattctacctttatagatacagaaaacggaatggtccgcagggatgaacctgctgaggtctatgctcatttgggaacagattttatagacatagaatggcagtttgtacagggaactatcgagtcgccggaagtccgtgatttgattacaggctggtgtgaagatgaggatgcgctgatgacggttgcagtctgcctgaacctgactcatcagtctatttcttctgctgtctatctcccgcgttgtgtctatgagaaaggtgttccggtgctggttcagcaacggataacatcggctatcattgaaaaattatccggtaatccgttgaagggaaaaggaggaaccaatcagcgtttcaagaatcttcgtccgttcgggatgttggatgattgtttcgacttgtgcatggcagacgagatgtatgccaagcgtgtaaatgcggtgtatgaaaagtgtgaaggagataaagtcttgacagaactgccatctgcgaaagaaatggacgaactatggcacaatccgaagttcaaaacggtaaagaaatggtctaatatttataatgcgaatgccattcctaccaaattgcgttcaatcggctacaccaaggaacattgggacaacggaaagcaacttagcgaaaagcaggtggcgattttggcagaagtggaacacaaccgctggaatgtggaagaactgttactgggatatagacctgtgacaaaaaaggaacaggaagagatagaacaaaaggcagccttgaagaataaaaagcgggatgaagaatatgctcattatgacattcgcccttacaacgatttgcggaatggcagtgagaaatatgatattgctttgacacggcatctgcttttgattgtgaagcaggacggaaaactataaaatggattaggatttgtgatatggggaatcatcaaaaggaaatattcttagtgctttctatctttctgactggctttcaatgtgtttgggcacaaaccactcagaaggggatcgtcgtggaaatgagtagcaataacaagcccgtagccggtgctgaaataaaagtagcgggtgcttcgcctacggacagcgatcaggaagggcggtttatactgaatttcaccgcttccttgccgggcgatccgttgatgattaatgatatctataagaaaggtttcaaaatagtcaattacgagaaagtagccaattggaatatatcgtctgcctccgaactgaaaattgtattagggcgtaccgaagtcatcagtgcgttgcgcaagaaatattatgatataggtgaatccaatagtgagaaagaatatcggaaaacattggctgaactggaagaactgaagaaacagaacgcattgtccgcagtggaatatgatcagaaagttgactccatgtctaaaagtatgatggaatggcagaaacgtctggaaatatatgcgcttaaatttgcctgcatcaatcgtgacgagcttgatgctatggaaaagcaggcaatggaactgctcgatcatggtgatgtgcatggagctattcgtctttatgaagagatgaaacttgattctgccatgacattgaagattgcagtcaggcaggaagcaaaagaagatatgaaactgcttcttccatccttagtcaataatttccagttgctgaagcaagccgatgataaagtggcgtgtgactctgttgctcacttgatttatgagatggcgacggatatcaagctgaaattaatgtcggtagagtggttctttcagcggaatgacccgagtgaagttctggatcagtatagcttgatagtaaaggagacgcaaagtatgcaagagattgagctggtggagaatagccttcagcagtcattgaaagaagtcaagttgaaaggagaactgaagaaaaaggcacagttggttttcgaacgaatcgaagaccgcaagaaatggatcagtataaaggaaaaaatatagaaacagatgaagaagatcaagatttttattgcatcatcagcggagttgaatgaagacaaacagatgtttgacttgtacttttcggataagaataagctttatcgtgatcggaatatcgacttcgaccagcgtacgtggatggacttcagcagttcgctgaatgaaggccgtctgcaggatcgctataatgactatatccgtgaatgtgatattgtgatttttctgttccacacacggatggggcgctataccaaagaagaactggaagtggcccatgaaatatatctgaagactaaggctgcaaaacctaaaatatttgtctatttcaaggaggaagggatcgttgatgagtctctcaaagattttaaatcttattgcgagaagaatctcggacacttctgcgacttgtataccaattatgatgatttgcgtctcaagttcgacaaacaattgcagattttggagaatgaaggctttatcaagcccgatccggtagatgtgaaacggacattgaggttcgtattattgtatgtccttgtgcctgtactggtggtggcactggctttctttgctttctattattattcgccggtcacttccacggtgcgtcttacggatacttccaaatcttctttgcctttttatggcgctgatataacattggagtatgccgataagagcgaaacccgtcatgtggacagactttctgacgaggttgtcttcaaagaaattcatactaaatatctgggtgagaatgcccgtctgaagatagaatcgaaaggatatgtgacggtagatacggtactgagcctggaaaagaatgtgactcttggcatcagtcgggattcttcattagcgatgattttcggtactgtgaaagatgaggataaccgtccgctggcggatgctactgttcaagtgctggacatgaagacggtatctgacggaatgggaaacttccaactgcccatacctgccgagaaacaaaaagaggagcaacgggtgacggtatacaaggatggatatcaattatgggacttcaccggaccggtatccgataaagtcccatggaagattattctgagaaagtaatgcctttactttctgtaaatgctattattgttggtccggtagtcattgataaggtagagcagaacggcatcgttaggcagcgtgccgctcttatactccagaccagtttttaataattcctcggagccgggctgggataatttggccagaaggtctcctttggcaaaccggacaacaagagggtaggagctgaaaagctgattgagttctttcagttcgtttgcgatgttttccgcctcttgcagaaatttcagagcctccgcattattgctgttctgatagtaggcgatacttgtattgagagtcatcagtagatagttcgtgccaagttgggctttattatgcggatacagtgtcttgatgatttcgtatgctttcttttgcacttccagtgctttggcatattttttaagtttgccgtatcccaacgacaggttattgtaggtagtggtgatactgcccatcatatccacgtcgttcggcttttgtttcaggtgcttttccctgtctttctttactttttccagatgttccactcctaattcatacagtcctccgcaaaccattgcggtgcctatactgttctctgttctcaagtcctgaaatccccatactccttgcatggtgtataatgcttccaggtcgatggcggctttcagagctttgtcatgttcggaaagttccaggagcatatcgatatacgatgcctgtgcactgataatctcaagaacaaatcttgccggattcaacagattcagtttttcggcatattggtatgcttgttccacatgcttcctttcttcgggtttatttccgtttttggagtaatatagaatgtattgtttctcgatattgtacaataatgaggtcttttgttcttcactgttgatttttaattcgttggctaccttgtcttcaaatgcttttatggtcgtgaggaagttttccggttctgtttctgtgcttacgctgatgtaggcgaagttccataaagcataccagtaggcgcgggacaagggacgcatcttatacagtttctcggcttttgccagaatctcttttatactgccggctgccagtttgtaatccgctttctctactgcctgatggaacaggtattcttgtcttcctatttcagcttcgagtatggcttcttcattatctcctgcattctttttatttagctcgaataatttctctgacagttcgttgactttagacacattgccttccttcttgtaaatgtctgtcagcgaactgtatatgttggcaagttgagaactttgaatatttatgaacagctgattgtcgctgtctgctatctcttcactgatttctttgatctggtcttcatagatttcctttgcttctttgaattcgttcatggcttcgtatgtctttcccattgaatagaacgtctgatggtagatagcatagtaatcgcccgaaggcatggaaatatttttgttggacagtatttccagtgcgttgatgtcatactccaaggctttgatatagtctttctgatgatgacgcgcaagggtactttttatgttcagtacttgtacgagagatttctcgtcaaatgaaagtttctggcatttgtccagccattccatggtatcactgtcttctagtcctattttctgcaatgcgtatttaaacacgtatgtaaacctgtcgggaagtgcttcggctacgaacttgtaggcatcatttgctttcttctcgttttccattcctccggtcagggcgcagaggtcggcatatcggtacattatttcggccagtttgtcgatgtcttcctctgcttttgttttctgtaacagcttctctctggcctgagtgataattccggatttattgtatagctcgatggcttcagacagtttcccggcattgaccagttccaatacttgcttctcgatggcgttgatgtcatccggatttattctcgcaaacttctcagcgtactgatcgatctgattcataaatgatctggattcttccgccatcgctttcagacggtcgctacgctcttgcagactgattttctgtgctatatatagctggttgatttcttcaatggctttttcttgtttcttcgaaaagtgggcaacggagatggaataatacttgctcttgctttcttctatagtgccctcgggagccatcacaatactcaacggacgtttttcggatagaatccatccattgatcatgtctttatttaccagttcatatcctttcttatatacattcggagaagcgatagccattcccggtttttgtttgctgaagttgaactggaaattcccgttggcatccgtatcggtggcaggggcatcggtagctgtcagttgtactcccggtagtggggacttatttgaattaaaaatctgtactgtacctttttgagacatttgtgcgtaagcacttccggatagtaataagaatatccagaaacaagcgtttttggttttcatagcttttatttcttaatgatgtatatgcaagtcaacaaaaggaatgtggagggagaaagtaatcgggactgactaaaaagtctgaaagctgattatatcctttttagtcggccccgggtatattggcagggagtcaggatcagttgtgtactactgttcctatttcttctccgctgattacttttttgaggtttcctaccgtgtccatgtcaaaaacaacaatcggcaggttgttttccttgcacatacaggtagctgtgaggtccatcactttcagaccgcgtttcagtacttcatcgtatgtgatgtcactgaattttgtagctgtagggtctttctccgggtcggctgtgtagatgccgtctacgcgggtacctttcagcattacgtctgcttcgatttcgatgccgcgcagtgaagagccagtgtctgtggtaaagaaaggatttcccgtaccgccggacatgataacgatttcaccgttttccatgcattcaatcgctttccatttgctgtagaattcaccgatcggctccatgcggactgctgtaagtacacgggcctttactccggctgctactaatgcggaacttaatgcaaggctgttgatgacagttgccagcatacccatctgatcacctttcacacggtcgaagcccttgttggctccgcttagtccacggaagatatttccgccgccgataacgatgccgatttgtactccctgttcatggatttctttgatttgtgcggcatattccgccagtcttttttcgtcaatgccgtattgtttttcccccatcaggctttctccgctgagcttcagcagaattcttttatactttgccatatctttttacatttagtttagcgcaaatatagagataatttgttggatagacctcatagttgcgcgataacttttatatcgctttcttcactatttctcttccgatgaaggtctgcacgattcccctcaatgaaaggtaagtgatgaaagccagccataaagcgtgatttcccaagagattgtggaaggcatagtagatcataaaaaagctgacggaagcaaccaacatcgaataaagcatctggcgggtggcggtggcgccgataaacacaccatcccataagaaagcggagaaacctgtcaatgggatggcgagtgcccaataaaagtaagtgtctgaggagcttattaccgaaacatcatttgtcagtaacccgagaaattcttttccgcctattgcatataaaagggtgaatgctgccgaaagtccgatgccccaatagaaaaggtgattgaccgtattgcggagagccgtttgatttcttgcgccgatatagcgtccggctaacgcttcccctgcataggcgaatccatccataatataagagaagagcgtgaacaattgcatcagcagtgtatttactgccagaacgacttctccctgtgcagctcctgcagaggtgaagaacatcgttacgattaccaggcagagggtacggaaaaagatgtcacggtttacccggaagaaacggtacattgcctgcttctgtatgatatctttccatacaatacgttttcggagcgtgctgtaataacgcatatacaatagtatggccataaagaaacctgcatactgtgcgataagggttccggcggcgactcctgccactttcatatccaagagatagacgaaagacaaactggcgataatattgacaatattctgcgtgatggcaatatacatcgggaagcgtgagttctgcattccgataaaccagcctgcaaatccataaagacctagcattgccggagctccccaaatacagatatagaaataggtagttgccagttgctttacttcttctgtagtctgtatgagtgtgaatgccgcattaaggataggatattgaaggatcagcaggcatagggcaataaagagtccgacgccgacagaacgtatcagtaaccggttgatttcgtttaagtcatgctgcccgtaggcttgtgaggtcatgccgcttgttcccatacgtaggaatccgaagatccagtagatgatattgaacaacattcctcctacggcaatcgctccgatatatgccggagagccgagatgtccaacgatagtgacatcgataagtcccagcaatggcacggtaatattcgaaataatcgatggtacggcaatctgtaatattcgtctgttttcggaggtcgtctttttatttatcatcttgtagaaacacttttatcaaatagattgttctttttgcgaacaaaggtacatattttattattttattgtatctttgcgtgtcacgaactagaaacaatgtaactgattatgaaaaccttaactctccttcttttttctttgttttcgttgccgctgatgctgaatgcacagacggccgatgaaatgttgcataaagtcacggttgctattgaggccggacagcatggacaggcggttagctatttccgtcaggctatcagtctgaatatagaccgctcggaaatgttctactggacgagtatagacaagagtagtgagatcagctcgaaactttctaatgagttggctcttgcctataagaagaatcggaattatgacaaagcctttttgttttataaagaactgtcgcagaaggaccctgataatgtagattatctggaggctgttgccgaaatgcaggtatgtcgtggacaggagaaggatgcgttgcgtatgtacgagaatatattgaagttggatgcggataatctggcggccaatatctttctcggtaattattattatttgatggcggagcaggagaagaaaaaactggaaagtgactacaaaaagctttcttcaccgacaaaaatgcaatatgcacgttatcgggacgggttgtcgaaattgtttgctaccggatatgagaaagcacgaagctctttacagaaagtagtgctacggttcccatcgacggaggctcagaagacgttagataagattttgaggatagagaaagaggtgaatcgctgagcggttcacctctttctatttaataacgggatataataatcttattttatcattcctatacggttcaatcttggtgtagctatcactagcatttgttctttagcttggttaactgcccttgtgggagtagtaactttacttcctgaaatcagactgattgctttggcatataaaggatcgctttcagttccaaagtctccatatccttcaaaatattctccgttaggctggttctcatttatctcgtaatcgggtgtaaaaccgttttcgaagtctccaaaacctttggcattgtatgcttggaaagtgatagggaaaagcaaatatttgtctgttcctgcagtaagttctactccttccattcctacatttttcccatgtgtggtggtgccaataaggataacttcgatatcaatacctctcagtgcattgattactaattcacttgcagatgcagagtcgtcagtaacaagacagtagattttttgtagctttagaccaccggcagagagggaagtactcaaattatcatattgagaatatgcgaatttctgaataggccgttggttgccaagggctttcatacgttcatcattatatctatatgaagcgaaagttttatcaacacagaaatctccggcaatgcaactagacataagattagctgatgttacatctcctccgccattgtagcgaagatctaaaattagctctgtaatattctgacttttaaactctttgaatacatcgaatagttcttggtcgaagccggattcaaaagctgaatacaccagatagccgatcttttcttttacttggtggtgaattatcgggttcgcataaataggtccggaatttattgtatatacttttccatctttgtcttttacttttatagaggttggagaggatggtttaattaatttagagtaacaagcttgcacgttagccgttgttattctctgattgtctatttcggttatttccattcctcgttttagtccttctttatcggcagatgatcctttatgcactccttgtataacaagaccataatttgaagtattacggtttccaacggctataaagtttacgaatccataattatactctagtgtttttttctcttttgcactgcgggaagtttgtaaatccggatctagcttctggataaatgaaaacaatgaataagtgccattactatttcgttttttgtctaatgtattagttgtcatacttaataatgtgtttctcaaaaactcatcataagcttgtctgaaattgggcgttaataacttataatcatcattccacaagtatttctctctcaaatattgatccacactatagttaatctcgtaaccttgcacatcatcatcgctcaactggattttgatattgctggcagatgaatatccatttactttaatcgtaatggtgccctgttcctgggaagacttgtgtactgtaacttttatggtattttcccctgaattacctgctgtattgtccaatgacaataatgcagtggaactgttttgagcagtccagctagacaaggtcgtgaaagtaaaagtgagggtttgctctgctgaggcaaaatatgtttggttagtagaccagctttgttctgtaattccactacctcgcagtagagtgtcatcatctttacatgatatgttgaggaataataaaatggtcagaagaccaactaacttgacatactgtattttcttcataaaattaaaggtgtttttttatatagcaaactcaaaggtaatgttttattgtttagaatgtatgtgttatatcaataaatattctacctctttaaacatatatcctctttttttctgcgcatcatcttccagaatcagcttcccttcaggctctacgcaaataattctcgcaaagaactctccatcagcatctttataccgatgcatcccttcttttctgaaaagagctttttcatatcggtgggctatgagttcagtgtcaccgttccggagcaattcataatcggattgaatgcggagcatgatattcttgagaatttcgaaaatgtcatactgctttcctgtgatttgccggagcgataccggatttggagcagtactatgaaatacttcctgattcacattgatcccgattccggaaatactctgactgatattgcgtcccatcaaatcattttcgatcagcatcccacatatttttttgtctttccagtagatatcattcggccatttgatggaaaaatcgtcagcatagctatctagttcctctttaatagccaaagacacaatctgagaaatcaagaactgccggcgtgcttccaagaaatccgggaaaagaacaaaactgaaaagaagattctttttgggttcagattcccacgaattgccacgttgcccacgtccggatgtctggaagtcggcaactacagtcgtaaatgctgcaactccctgttgcttggcacaaagagtctgcagataactgtttgtagagtttgtctcactgatgtgaatcaatgggacaggaaatgacatatcaggggagggcatcatattcagcacgcagtttcttagtgaatttcttgataacttcctcataagaatgatcgacgagttcctttattaatttatcgtctacgtctttatcgaagtaaacgccattccaatatttcttgttgaaatggtaggctccttcaatgcctgcataatgttcgcgcagttcgatggcacgttccggatcacatttcagtgcgatgaagttggctccttccaagtcgatgagggcaaacattttgtccatcaccttcataaccagcgatacatcatcaaatgggaatgattcggtaaccccttttttacttaagcagtattccctgatcgtttctacattcataagtctttcgattttatgtttttgctcttagttaaaatacttgtttcctattaaaataaaggaggataaaaagcttcctttatatggtctattctgaaatttccgttctcgccaatgacagtgatgatatcgaaacgtaccggaacgtcaatctgaaatagtttcatatatgtgtcggcagcacgtactgtccgtttaatctttggtaaatcgacggcttcttccggttgggcaaacaaagtattactgcgtgttttcacttctactatcaccaattcgttctctttggcggctacgatgtccagttcgaagtgaccttttctccagttccggtggcggataagataaccatgctcttcgagataggctactgcggcattttctcctgctttccctaattcattgtgttcagccatctttttttgcaaatttacagcttttattctttgtttttacagaagtaaaagtaattttgcagaagatatgagaaaaaggagcaaaaagtgcctgaaaatgcacgctgagtataccaaacgggaacggcggatgagcattttgttgagcgaagacgagcagctgattgtcgatcgttatctggaaaaatacaagataacgaataagtcacgctggcttcgcgaaaccattctcatgtttatccataaaaatatggaagaagattatcccaccctcttcggagaacatgacatgagacgctgatgatgacgctggacgatacttacttcatgaaacaggcattgatagaagccggcaaggctgcagagcggggcgaagtccctgtaggagcagtggttgtctgcaaagaacggatcatagcccgtgcccataacctgacagagacattgaatgatgtgacggcccatgccgaaatgcaggctatcacagctgccgccaacgtacttggcggaaagtacctgaacgaatgtacgctgtatgttacagtagaaccttgtgtgatgtgtgccggggccattgcttgggcgcagaccggcaaactggtttttggtgcggaagatgataagcgtgggtatcagcgatatgcggctcaggcgctgcatcctaaaacggtcgttgtaaaaggaatccttgcagatgaatgtgccacattgatgaaggactttttcgcttctaagagaagatgaaacagtgattagtaaactgctggctacacgttactaaccactttctatattatattattttacttcctcgaaatccacatattcaccatcatcctgagtgaatattttcttatgtttggttcttgggctgttttcagcgaagatttcctcttcgttatcggcacggctgtccgtgttctggttatagctgggacgatgttgctgctggccgttttgtccactccttgcctgcttcgtccgggaagacgaaccacggccaagcccgaaaatggctcttaatacaaatccgacaatcgaaaggccaaatatgacaatggcagctagaaaaagaagtaagaataaaagtatatgcattgggctatgattttatgttgtaacttcgataaaactcatagtacaacaaacgtgccaagagattgtttatttactttttcttgtaaaaagtgaaagtaaaatataccagacaatgatcgctgcgaaactgctgatacctaagaaaacaaggaatgggatacatacaatcaggaaaatgaaactgattttatttgtactccatgaaagattcttgaatttcaacgagaacatcggtatctctgacaccagcaaccacgaaaacagacaaaccaataaaataaggtagacaggatggcagttctcagaaacgaggaagtcatgcgcccctactacgaacgatccccagaataaggcgtttgccggaacaggaagacctacgaaagaactggtctgccgggtatcattattgaatttagccagtcgtaacgctgagaatacggaaatcaaaaaggctgcgtatggcaggtaaggagcaagaaattccatatttgccggatagtacatctctttaaataaggagaatacaatcagtgagggagccacaccgaagctgacatcatctgcaagtgaatccaagtcttttccgatgattgagtgtgcattgagaatacgagccagcatgccatcgaaaaaatcgaagactgcactcagaacaataaaaagcagtgccaggtcataacgggcttcgaaagccatgacacaagcgatacaaccggagaaaaggttcaggcaggttactgtattcggaatattgttctttataacatttgtcattgtgaccgaattatttaagtttggcgataaccgtctggttaccggtcgttaattgtcccatgttgacacagacttctgtgccgaggggcagatatacatccacacgggaaccgaatttgataaagcccatgtgttcgtcgatatagcattcttctcctacttctgcgtaggtgacaatgcgtcgtgccacggctccggcgatttgtcgggtcagcacttccactccttccggagtttctatgactacggtagaacgttcgttctccgtactggctttaggcaaccatgctttcatgaagttaccgttgtggtgggctacctttttaatggtgccgtccaccggataccagttggcatgtacgttaacgatgctcatgaagatagagatcatcaaccggcggtcatggaagtattcgttttcgtccacttcttcaatgactacgattttgccgtcagcaggagcgacgactatcttttctgtatcctttccgaaaagtcggattggacagcggaagaagttaaccatcagcagatatactgcaatactggctactgcaaccacataaaaaggaattttgcaatctattccccaataaagggccgcattaatcagtagcagtagcagaaagctagcccataatatatgtgttccttcgcggtgaatacgtatcttttttaatttttttagtcggcccatgaatgctgtttaatgatattgtgtgcaaaaatatacttattttaaaaaaacagcaagtaaatgagcagagaaatgcgagtgttgataactttttgaggattatttttgtttataacgcgggaggtagtaattttatgccttcaaattaactacttatcattatgcaggatttcgttcatttacacgttcatacgcaatattctctactggatggtcaggcaagtgtcgcccgtctggtagataaagccatgaaaaatgggatgaagggtattgccgtgaccgatcatggaaatatgttcggcatcaaggaatttacgaactatgtcaataagaagaatagcggtccgaaaggggaaatcaaggatctgaagaagcggattgcagggattgaagccggcacagtggagtgtgaggataaggaggcggagatagctgcctgcaaggcgaagatcgtggaggcggagaacaagctctttaaaccgattatcggttgtgagatgtacgtcgcccgccgtacgatggacttgaaagaagggaagccggaccaaagcggttatcacttgattgtacttgccaagaatgagaaaggttatcataaccttattaaattagtatcgcacgcgtggacgcgcgggtactatatgcgtccgcgtaccgaccgcagtgagctggagaggtatcacgaaggtctgattgtctgctcagcgtgtttgggtggcgaggtgccgaagcgtattaccgcagggcagtttgacgaagccgaagaagcgatccaatggtataagaacctgtttggtgatgactactatctggagatgcagcgtcataaggcgactgtaccccgtgccaatcacgaatgttatccgctacaggtaaatgtgaacaaatacttgcaggagtatgcccggaagtataatatcaagctgatctgcaccaatgacgtccactttgtggatgaagagaatgccgaggcacacgaccgtttgatctgcctgagtacaggtaaagacttggatgaccccagccgtatgctatataccaaacaggaatggatgaaaacccgtgaagagatgaatgaactctttgcagatgttcccgaggcactgagcaatacgctggaaattctcgataaagtcgaatattattcgattgaccatgcacctatcatgcctaccttcgctattcccgaagatttcggaacggaagaaggatatcgtgccaaatatacggagaaagacctgttcgacgagtttacgcaggacgaacatggcaatgtggtgctgagcgaagaggaagggcaggccaagatcaaacgtctgggaggatatgataaactgtatcgtatcaaacttgaaggcgactatctggcaaagttggcatttgacggtgcgaaaagaatatatggtgaccctttgtcggaagaagtgaaagaacggctcaacttcgagctgtacattatgaaaacgatgggtttccccggatacttcttgattgtgcaggactttatcaacgccgcacgtgtggaactgggcgtatcggtaggccccggacgtggttcggctgccggttcggcggtggcttactgtctgggtatcaccaagatcgaccctatccagtacgacttgctgttcgagcgtttcttgaatccggaccgtatctccttgcccgatatcgatgtggacttcgatgacgacggtcgtggtgaagtgcttcgctgggtaaccaataaatatggtcaggaaaaagtagcgcatatcatcacatatggtacgatggctaccaaactggctatcaaagacgttgcccgtgtacagaaacttcctctctcggagtccgaccgtctggcaaagttggtgccggataaaattcccgacaagaagctgaacctgcggaatgccatcgaatacgtccccgaactgcaagcggctgaggcatcgtccgacccgttggtgcgagacactcttaagtatgccaaaatgcttgaaggtaacgttcgtggtaccggtgtccatgcctgcggtacgattatctgtcgtgacgacatcaccgactgggtgccagtaagtacggccgacgataaggaaacgggcgaaaagatgctcgttacccagtatgaaggttcggtgatcgaggataccggattgatcaagatggacttcctcggattgaaaacattgtctattattaaggaggcggttgagaatatccgtctgagtcgtagtctggagatagacgtagaccagatcgatatcaccgatccggcaacttacaaattatatagtgacggacgtaccatcggaacattccagtttgaatctgccggaatgcagaagtacctgcgcgaattgcagccttctaccttcgaagatttgatcgccatgaatgccctctatcgtccgggtccgatggattatattccggatttcatcgaccgtaagcatggccgtaagccgattgaatatgacattccggtgatggagaaatatctgaaagatacgtatggcattacggtctatcaggaacaggtgatgcttttgtcacgtctgctggcggactttacccgtggtgagtccgatgcccttcgtaaggcgatgggtaagaagctgcgtgataagctggatcatatgaagcccaagtttatcgaaggcggacgcaagaacggtcatgacccgaaagtacttgaaaagatttggactgactgggaaaagtttgcctcttatgcgttcaacaaatcgcacgctacttgctactcttgggtagcttatcagacagcctatctgaaagcgaactacccgtcggaatacatggcggctgttatgagccgaagtttgtccaacattacggatatcacgaagctgatggacgaatgcaaggcaatgggtatcgagacgctcggtccggatgtgaatgagagtaacctgaagtttacggtcaaccatgacggtaatatccgtttcggactgggagcggtgaaaggcgtaggtgaagccgccgtgcaaagcattgtagaagaacgtaataccaacggaccgttcaaaggtatctttgacttcgtacaacgtgtcaatctgaatgcctgcaataaaaagaatatggaatgtctggcgttggcgggaggtttcgacagtttccccgaattgaagcgggagcagtactttgccgtcaactctaagggcgaagtattccttgaaaccttaatgcgatacggcaaccgctatcaggaagacaagagagctgccatcaattcattgttcggcggagcgaatgtcgtcgatattgccacccccgaaattcctcagggagtagagcgctggggcgacctcgaacgtctgaacaaggaacgcgacctggtaggtatctacctttccgcccatccgctggatgagtttgcgattgtgctggatcacgtctgcaatacccgtatggcagatttggaagacaaggcggctctggcaggccgggagattacaatgggcggcattgtgaccagtgtccgtcgtggagtcagcaagaatggcaatccgtatggcattgccaagatcgaagactattcgggctctacggaaatacctttctggggaaatgactgggtgacttatcagggatatctgaatgaagggacgttcctgtatatcaaagcccgttgtcaggccaagcaatggcggcaggacgagctggaagtcaagatcacttcgatggaacttctgcccgacgtgaaagaagaactggtgcagaagatcaccattattattcctctgtcggtgttaaattcgggattggttaccgaactggccactttgaccaaagaacatcccggcaatacggaactctacttcaaagtgacggacgatacggacagccgtatgtcggtcgatctgatttcccgtccggtcaagctttcggtaggcagagatttaataacatatttaaaggagcgccccgaacttggattccgtataaattgattatctttgtagcgcaaatctacaaacgaagtaatacataataattaatacttaatacttaaaaagaaatggctttagaaattacagacagcaactataaggaaatccttgcagaaggaaagcctgttgtggttgatttttgggctccctggtgtggcccttgtaaaatggtggctcctattattgaagaattggccgcggagtttgaaggacaagtcatcatcggtaaatgcgatgtggatgataacagcgatgtggctgccgaatacggtatccgcaacattcctactgttttgttcttcaagaatggtgagattgtagacaagcaggtaggcgcagtcgccaaaccggtattcgtggaaaaagtgaagaaccttctctagactttgtctaatatttaatacttattacttaatacttacaaccatgggactggaagatgattttttattagaagatgccgatgacgaaaagaccgtcgagtttatcaagaactatctgcctcaggaactgaaagagaagttcgaggacgatgaactgtactattttctcgatctgatagacgagtactattcagaaagtggcattctcgacgctcagcccgataacgacggctacgtaaacattgacttggaagaggtcgtagcttacatcgtgaaagaagccaagaaggacgaaatgggagaatatgatcccgaagaaatcctttttgtggttcagggagaaatggaatatggaaactctctggggcaggtggactaattgtcgctagtcaccactgtagataaatgaaaggaatatagcctgaaagattcgcgtctttcaggctatttctttttccatccttatgttttcgctttccggtatttcctgccaagtaaattggcagcacttcctcagaatacactgtacctgctatctacttattttattaaatacccatgtgggaaatagtttcggggctttcagatttttagtatctttgttcgttgttttattgcgtatcactaaggtctgataattgaagcaccttggtgcttcaattgttgtacgtaggtgactctttcgttgcacctaagtgcaacgaaagaaaataaccaagcaaacgactaattgcttaaatagtaacagataagttattaacagccaaacataaaattattcttatgagcatttattacgacctttatgagaatccggataaagagggtaccgaagaacagaagttactgcatgcacgagtagtgccaagcggaacatatacaaccaaagagtttgtggagcgggtatccatgatgcaccatattcctcatgcgcaattagttggagcagtggaagctatcactgatgagttgcagacgctgctgtccagaggatatattgtggagtttggagatttggggcatttttctctgaccctctctttggagaaagaaatcactgacagaaaagaagtgcgctctccatctgtccatctgaaaaatatcaaactaaaggtaaagcaaacatataagagagaactgaactctaaaatggatttagaacgaatatcttcccctacgcgttccaatatgaacatatcagaagaagaatgtctgaaaagattgcaggactttttggagaaacatccttgtatcaatcgggcagattattgtgctatcaccggaatgaataaaacacaggctatacggcaattgaatcttttcattgaaaagggagttattcagaaatatgggattgggaagacggtagtgtatatacgtgttgtgtaagttcttattttagatttcctccaatgcataatactgataatcccgaagtaccgtttggaggaacttctcctgattattctctcgtggagtaacagataagatttcctgcacctttttggcgagtaacgtaacgcgccttacccgatccttttcaccggactccagcgttcgggtgattacgttcacctgttccaatgataaatcggcagattgtggatacgtcggatgataattctttgtcagatagtcaaattcatcgaggctgacgtgtatcttgcgataattcttctctttgatcaccatcgttccggctgctaaatcacccagtctctgactgtttttagtcagcagaacgactaaaagccctaaacctcctgtaccgggaccatcaatgatgaagagaagccagcgcagcagataagcactgatgctgggagtagaaccgtctgattttacgacgcgtatattcatcagacgttttccgaaactctgcccgtgattgaacatttcgcagaggaacgagtaaaaaagtacaggcaaatagacgaggcacagaaaaaagaccgtaccgactccggaggataaatgcagtttaacaatgagtgtcgtcacagaatatagataaatcacaatcagggaataatcgatgaccaaagccagcaatcgttcgccgatactggcgggcgtttggctgattcgaacaaactgaccggtaataatcgtagattctgccattcttggttaaacatttttaggtttaagttgcaaatatatcataattcttttatttttgcttctgctctcaaacaaaacttattcgaaatctattaaaagtgatgaatgtaaactatgtctatggaatcatcttcctgtttttaacatcttgcctttctcccacagatagggtaattccttctttattgcgtgcagattctttgatagaagttggatgtgcagatagtgcattgagtttattggaacgtatgaatcttgctgagttgtcttctatacagtctagagctagttatgccctattgttaacacaagccaaagatcagaactatgttactcacacggatgattcgctaattcgtgtcgctgtagattattatgacacttccgatgatattaccctaagggcaaaagctcattattatcttggacgagtttgtcaagacagaggtgatattgaaggaactgtacgtgaatttttggtggcaatgcctttggctgagaaagcggaaaattatgatttaaatattctattgaaaagtaatttgggtttattattctggcggcatgggttgcaagaggaggctgattctctttatagacaggctgttgaattggctgaagcacatcatgattcattgcgtttagccgtagtgctagtacattgtgcagatatttgcatggagcgaggagaagaatattatacagatgcggaaaaatatttaaaacgggctctaaagctagtgaaagatacagataaacaacatactgaggagcttgtgtttagttctcttagttatcttctggaatatcaagggaaatcacgcgaagctatattgtatgcaaataaaggtatgcggttggtattagacagctctgagagatatggttactatctagttatcgggagtgcttatttgcaattggaacaatatgattcagcctttgtttatttgaatagaggcataccttctgataattattatgcaaaaacaaatgcatacatgaaactatcggaaatggcgatgaggttgggaaaacaaaatgaagcattggagtacgaaactttatatactatatataaggattccatgaaattagtagagcaaccggttgaggtagtttcttctttaaaggatgtgttatatcgtcaatcaacggaacgctatgaatcctttttgacccggtatcgtttttgtctattgttatttgtcctattgtttattattacgatttatttctttttgcagaggcgtagaaaaaggaagaaagaaatagcacgattggttgacaaacgtcaattgttgtataaaagtatagaggctatcaagaaagagttggaggaaaaaaaactagaaataaaagaaatacagcaacattgtgaatgtttagagtcggatgttaactccaaagtgcaattagatagttgtcttaatgaactattagaacaataccattcaatgcaagaagatttagaacgccggcttgtagaaagagatgaggaagtaaggcgattgagaaatctgaatctgaaatttatattaatgtcttctcctatttatcaaatgttgatagcattgtgtgagtataataaacttaaccctgatggaatgaagaagattactaatgatgaatgggtaattttattgcatgaaatagatatggcatctttgggatttgtagaaagattaagcactgaatatgagtatttattggaggaagatattcgtttttgttgcttagttaggttggattttaaatatgccgatattgcctatctttggggatgcacttctgctgctgtatataaaagaagttggtctgtattggaaaagatgggtttaaataaagataagaaagtaaaattggttgatatattacgcaaagtctaagctttgtgtattattatttgagttttatgcaatacaacgcattctttgcattcgttaacataatggtataatacttttcttaagcttactgctcatatttacagcgttaaacatcaaatatgaacagtatatgaaaaaactactatttttattattcctaggtattttcttttcggatctaatactaggaaattctccaaattgtaatataagaggttgcaatatggaattgagttgttcttctagaaaaataattttaaaaggaaagggtagtaaaccaggtgaaacgactcgaataccagctatctacccagttgaagcatctataaataacaatgtattgtgcctcgactttttttcaaaagtacctagtgtgacagtttccgtaattaatttggatactaatgagacagtgtatctaaatactttcataaatcctgtaagtctgattactttagacctgaatttggtggaaggaactgcttaccgcttagaacttttgtctaaagattatgatttatcgggggattttgaactttaattaactataatattatgagaaaaatatttatacaattttatttgttagtcgtgcttattattatcgcctcgtgtagtaacgagaatataatagatgcagaacggaatgcaattaaacaagtagatcctaatgcgttatctgaaaatgaagttatttctattgtagaatcctttcaaaagtctatcaaatctaagacagatacgagaggcgaaataacagaaaatccaatttttgctattagtgaggaatatttaatatcgtctcgaaattcagaaattacccgttcgttgcctaatgatgtaaaagctttagtttatgaagttgaaataaggaatagatatgaacaagggaaagctattgtatctggtgatagaagattcccaaaggtattggcgtatataccttcctataatgactccatttttgcaacgcagataggagcaaacgctatgattcaaatgtcgaagaatgcattattagacgaaatagccaataatagtgaggcaattacacgctctaggcctattactgatttagatggccaggtttggatgatgattgaacctttctgtactacagaatggggacagaaagaaccatatagttggaagtttgtaaatacttgggttgaaatacctatggatatttctcgtaaaatatgtacatgggaaagacgcccagtaggacttaccaacactgcaatagcccaaattatggcctccttagagcctgaattaacttgtgaagggatatcaatggactggagttatttaaaagaaagtaaaagtattagttatgatgatccttatgagaaatggaatatggttgcatctttatttaaatatgtatatgatagtacatcttcttctccagtttggggaactgcctatactgatgtatggccggactcagaatctaaattagtgtcttgcattactgcaatatcaactccattatctaatgtgtataaatatctaaattcaggaagtggaataaccaattgtggtaatattcaaaaatggagtatagaaacagttaaaaattctgttattaaaatatgtcctgttttggtagaatgtaatggaagtgcttttatagtggatggttatgcaatgacaaagaacgaatcttctagcagtaatgcatattttcattgtaattttggaaagacaggtaattctgatggttattatttggtaaacaatgatggaagcatttcatttgagactggtggtaatacctattgggatacgcaattaagtgttatacctgatataagaaaaagataacattgatttattattgtacagattacatattcaattgaaacttaaaaatatttattatgaaattaaagtattattttttgtttttcgtattgtcgttattagcttcatgtaatgatgaagaaggtttggatttacataataagccgatagaatctaactcaattgtattatctccggatgaatacattagtattgcttatgataatccaagagtaataactcctgatgaggcaaagcaacttgcattagattttggggttaacagagtgcagacgagaggtaatgaaaatattgttgtgaagtttcgctcttcttttaatattgaagaaaagggcagcaatgcggtaacaagatcggttacagacaaatcaattcttcttcctgtctatgaaatggaaatagtcagtgatgcagggaaaggacttgcttatgtttctgctgatgagcgtgtggcaaaggttatggcttatttgcccaaggtaaatcttgaggatacagctaaaattattggtgcgaaggctatgcttggtttgtcagaacaaagcttgttagaggaggccaaacattatgaaaaaatgaaattggaatttagagatgaaacattaaaaagaatatcgaaagagctcaatgttgcagccgtaaattttaatgagatcaaagataggattcttgtcgaggattgtctagattcacgtgcaacccctcaagatcctgctggcaatgctattgggtgggctggttttttttgtatggcgacaaattgggatcaagaacctgtatataatgatttattagagaaagcatattgtgcaccaaatgttgggaaggaacctgtatataaagctgttcctgcgggttgttcggttgttgccatggcacaaattatggcttcacttgaaccaaacttaactatcgatggtataaaaatagattgggaagcattgaaagcacagccgcagatactaatgccgctaccctggaagccaaatcagggatcacctgagattgttagaactatggttgctaaattatttaaacatatttatgacctttctggtactcatccagaatatgacaaaacaacaaattgggtaacaggttctggtacatctggacctcaaactagggattttcttagaagatattttacaacaggagatttgataaatggttgggatggtaatgctgcatttttgtctttacagaaagctaaactggtatgggttggcgtttcagatgcttctaaaaaagcttctcatgcttttgtgatagatggatttgcttattggagacctcaaacgagatatttggttaaaaactttgatttttatttccgtgcgaatatgggatgggctgggtcttatgatggcttctatttagttaataaagatatgtcgatatcttttgaagctggaggctatgaattaaacacaggctttaatatgatctgtgatattatattgtaaaagaatgaagtatattattctgatttttcttcttgctattgttagttgtaatgatgcagaagatgatgaaatatatatcaatgattttccccacaggatatcagagcctccattattagataataaaggtgatactgcttttattattatgactcctgcggaaggatggagattgcatgctgctgggactgttgtgaataaggattctattgctctcaatgtaaaaatgacccatacttttttgcttgaagaagattggttttcaataaaaaaagaacaggaggattcggtgatgacagtaattgtagacgaaaatacatctggtgatattagggagataatcttatggctttcttatattggctcatcaatgagcacatatacaataaagcaaaatccataaattatataacttatgaaattgaaatactattttttgttagttatccttgctttatttacttcatgtagtaatgaactaggtatgcaagataatctgaatgattctaaaattttattatcttcagatgagtatattagcattgcttatgataatcctggaataattacttcagaagaggctaagcaacttgttttggactttaatccaacaggattacagactagaaataataatgtaaaaattatggctatttctacatataatgtatctagttcttctggattaaaaacaagagtcggttcaactaatcttactactattcctgtttataaaattgaatttttaagtgatgaggggaaaggtgtggcttatgttcctgctgatgaacgttttgcaaagataatggcttatttgcctaaaacagatttaaaagactctgttaaatatgtagattctaagtctatgctctatttatcagaattgagtctgttggaagatgccaaatattatgaaaaggtaaaatcaaaactgagagctaaaacattagcgaaaatagcaaaaactttaaacgtgaaggctgtgaggtatgatgagattcaagatataattatagtaaaggatgagattctatcccgttctggaccaacatttcctgttggaaatccgataggttttgctggtctgtactgtagtagtacagagtggaatcaagacgcaccatataatgatttgctacagaaagaaaattgtgatctttatgatacaggctcacctacttacgaggctgtccctgctggttgtgctgttatttcaatagcacagattatggcttctttagaacctgacttaacggttgatggtctgaaaattgattggaatatcttgaaagcacaaaaacaaattattgctccttcatcttggcaaactccttcctctgaaacaactagagaaatggttgctaaattgataaaatatatctatatagcaactaatacacagcctgttagaaattcaagtggttatgttactgggtctggtacttattcttctgatacatctagctttttctatcgttttttttcaactagtggtcttaaaaatggttgggatggtaatgctgcatttcaatctttacaactagctaagttggtatgggtagctgcaacctctaatcgtgggggaagccatgcttttattttagatggttttgcatactggagaccccaaacaagatatttggttaaaaactttgatttctatttccatacgaatatgggttggggaggatattacgatggcttttatttagtaaataaagacctctctattacttttgatacatctaatggaagttatgataggaacttttctatgatttacaatatcataaataaataaactggggcttaggtctgttttgagcagcaaaggctgatttatagtctttgttgctctttttattgaatatttaaataataatcgtagattctgccattcttggttaaacatttttagatttaagttgcaaatatatcataattcttttacttttgcttccggtttcggacaaaacttatccgaaatctctgaaaagcatgaaggaagttacgtttatccgtcggaacattgaaaaatggaaagggaccgaaaaggtggtggaacaggctgcaaacctgtcccctgaccaacttgccgacgcctatacggaactgactgccgacctggcttttgcacagacccatttcccgacttcccgcattaccatttatttgaataatctcgcttcagccctgcataatgaaatctatcggagcaagcgtgagaaatggacacgcattatcactttctggacacgggaagtgccgcagaccatgcatgatgcgcagcgtgagttactgatctcttttatcatctttgccgtcagtgcgttgatcggggcagtatctgccgccaatgatcaggagtttgtgcgtttgataatgggcaaccaatacgtagatatgacattggacaatattgccagaggtgagccgatggcagtatacaatggctctcccgaagctccgatgtttctgggcattacaatcaataatataaaagtatccttcctgtgttttgccgcggggatactgaccagttttggtacggggcttatacttcttcagaatggaattatgctcggttcatttcagatgttcttttatcagcacgacctgctttgggagtcggcacttgccgtctggctgcacggaactcttgaaatatgggcgatcatcgtagccggtgctgccggacttgctttgggcaacagttggttgtttcccggcacctattcgagactcgaatcttttcgcagaggagcgaaaagagggctgaagattgtaatcggtacggtgcccgtgtttatcatggcgggatttatcgaaggctttatcacccgtcacaccgaacttccggatatgctgaggctcggcatcatccttacatcccttgcatttatcatcttttactatatttatttaccaaatagaaaaaaacatggaatcacagaaacctaaggttgcaatgtacgtgaaacgttctttcggtgataagttgaacgcttcttttgacttcataaaagagaattggaaaatactgttgaagtttacgacttatctgcttttgcctgtaagccttattcaggcattaagtctgaacggactgatgggaggagcgtttgccatgactgctatgtccaagactgcgacggtgccggatactgcatctttattgggatttatgtcctattacggtctgtatatgattgtatttatgataggcagtattttgctgacctccatgatctatgcattgatccgtacctataatgaacgtgaagaacgcttggagggaatcacgttgggtattttgaagcctttattgttccgcaatatcaagagactgcttgtaatgacccttttctccatcttagtcatgcttttcgtggggcttgtggtaggtctgctggcgtttctgtcactgttcaccttgtttctgaccattccgcttcttatcgcttttgtagtgccgcttgcattatgggcacctatctacctgtttgaagatattacagtgatggagtctttcaaaaagacattccggctgggctttgccacttggggaggcgtcttcttgatatctctgatcatgggatttatagctaatgtattgcagggagtgactatgatgccgtggtatatcgctacgctggtgaaatatttcttctcattaagtgatgtcggaagcgagacgacagtatcggcaggatatagctttatcctttatctgcttggtattgtacaggcattcggcgcttatctttccatgattttcacttttgtcggaatggcctaccagtacggtcacgcttccgaagtggtagatagtgtaactgtagagagcgatattgataatttcgataaactctaaacatatataattcagaatagatgctgacatccccggctgatacattggtttgcgacaccgtgcagattgccaaatggcaatccgaatcggcgtatgactacaatcgtgaactgataactcctgaaatcaatatctttgaatggtttcgcaggcagtttggggaattgttgcggaagatattcggcagccgttttgccgaagagtattctgaacttatattaatatgtctggccattattattctgctcctgattatatggtttgtttataagaagcgtccggagttattcatgcgttcgcccaagaataaactgccttatgaagtgggagaagatacgatttacggtgtggatttttcgggagggattgccgatgcgctttcccgttccgattatcgggaggcggtgcgtctgctttatttgcagacattgaaacggcttagcgacgagaaacgcattgactggcagccttataaaacaccgacacagtatatcaatgaagtacggatacccgttttccgtcagttgaccaatcatttcctgagggttcgttacggtaactttgaggcaacggaagaactgttcaattccatgaaatccttgcaggaagaaatagggaaaggagggggctcatgaggggaagccgctggtttatcttctttgtccttgcttttctgctgctgatgtttgctatagaatatcatctgccgaagaaatttgtatgggtgcctacctttagccattacgatgagcagcctttcggatgcgctgtgttcgacagtctgctgactgtttcactgccttcgggatatacactgtcccgaaagactttttatcagatggaacaggaagatactgttcacaataaaggaatactgctgattgccactaatttacctttcggacgggtggatatagaagccttgctcaaaatggcggatcggggaaataagatcatgctggtaagcagttcttttaccaagattttggaggatacgctgaagtttgattgcacttattcttatttcagatcggtcgatttgaaaaaatatgccgcttcgttattgaagcgggacagtatttattggatcggtgatccggaagtttattcacggcaggtgttccgtttttatccgcagttctgcaagtcctatttccgccgttatgattcgctgccggtacgtaaactggcggagatcaatctggcaagcgatatggggcacgcattggatgaactggattctacgaccgtttcccgcaattatcatccgttggtggctatggtgcgtccgtggggaaagggtgaaatcattctggtttctactcctttgctttttaccaattatggagtgctggatgagaaaaatgcgacttacatattccgcatcctgtcgcagatgggagagttgcctattgtccgcaccgaaggatatatgaaggagactgcacagacgcagcgatctcctttgcgttattttctgtcgcaaaggccgcttcgctgggcgatctatctgtcgatgttcgctatcttgctctttatggtgtttacagcacggaggcggcaacgggcaatacctgtcatacaggaaccggaaaacaaatcccttgaatttaccaagttgataggcacgctttattatcagaagaatgaccatgccaatctggttcataagaagttcacctactttgcggaagtgctgagaagagaaattcaggtagatgtggaggaagtggcggacgatgaacgttctttccaccggatcgctcagaagacgggaatggaggtggaagaaatcagcaggttaatccgcgaaatcagaccggtgatttatggaggacgtgtcctttccggcgaagaaatgaagggatttattgataaaatgaatgaaataatcaatcatatttaaagaagatatttatggaagagaatatagaacaacgagtggatttaactctcttttccgagaagatacaggaattgaaggatcagattgcttccgttattgttggtcaggaacagacggtggacttagtgctggcagccatcctagccaatggtcacgtactgatagaaggcgtgccgggagttgcaaagacattgcttgcccgattgacggctcgtctgatcgatgcggacttcagccgtatccagtttacgccggacctgatgccgagcgacgtattgggtaccactgtgttcaatatgaaaaccaatgattttgactttcatcagggaccgatctttgccgatatcgtattggtggacgagatcaaccgtgctcctgccaaaacgcaggctgccttgttcgaggtgatggaagagcgtcagataagcattgacggcactactcataagatgggtgaactctacaccatccttgccacacaaaaccctgtggaacaggaaggaacttataaacttcccgaagcgcagctcgaccgctttctgatgaaaataacgatggactatccttcgctggaagaagaagtggatattctggaacgtcaccatacgaacgcttcattaatcaagctggacgatatcaagcctgccatcaccaaagaagaactcctgtcactgcgtgccttcatgaatcaggtatttgtagaccgtacgctgctccaatacattgcattgattgtgcagcagacgcgtaccagcaaagctgtatatcttggtgcttctccgcgtgcatcagttgcaatgttgcaagcctccaaggcgtatgcccttttgcagggacgtgacttcgtgacaccggaagatattaagttcgttgctccgtatgtgcttcagcatcgtctgatcctgacggcggaagcggaaatggaaggatattctccggtaaaggttacgcaacgcctgattgataaagtagaggtccccaaataagaaccgaatctctataattcgtaactcaaaacttaaaactcaaaactcagaacctgaaattgtacttaacccgtcgtttctatattgcccttattctggttatcctcttattgggtagcggatatctgtttgctccgttttttgtcatcgggcagtgggcgctttttgccttattcgtgttggtatcggcagacggatatattctctaccgtacccaggggattcaggcattccgtcaatgttccgaccgtttctccaatggcgatgacaatgaagtgagcattcgtgtcgaaagtacttattcgcgtccgctctctctggagatcatagatgaaataccttttatcttccagaatcgggatgtctgtttccggaccacccttcagccgaatgaggggaaaacaatcagttaccatcttcgtccgacccgtcgcggagtatattcttacgggcaaatccgtgtatttgtgaccgacaagatcgggctgctttcccgtcggtacacttgtggacagccgcaggatatcaaggtatatccttcctatctgatgcttcaccgatacgaattgctggcaatgagtgataaccttaccgaactgggtatcaagcgtatccgccgggtaggccatcaaacggaatttgagcagatcaaggaatatgtaaagggagacgactaccggactatcaactggaaagcgagcgcccgccggcatgaactgatggtaaatgtctatcaggacgaacgttctcagcagatttacagtgtgatagataaaggcagggtgatgcagcaggcttttcggggaatgactttgctcgattatgcgattaatgcttcgctggtgctttcgtatgtggcgatgcggaaggaggataaagcggggttggtgacttttgacgagcattttgatacgttcgttccggcttccaagcagcccggacatatgcagacgctgcttgaaaagctatatagccagcagactacttttggtgaaacggacttctcggctctttgtgtgcatctgaacaagcacgtcaataagcgtagctttttggttctgtataccaactttgccagtatcagcagtatgaatcgccagttggcttacttgcagcagctcaaccgtcaacatcgtttgctggtggttttctttgaggatgctgatttgaaagcgtacatcgaaagtccggcgagggatacggaagattattaccggcacgtgattgccgaaaagtttgcttttgagaagcgactgatcgtttctacattaaagcagcatggcatttactctctgctgacgacacccgaaaatctgtcgattgacgtaatcaataaatatctggagatgaaatcacggcaactgctatgataagtctttaataatattttctactgtttcttttaaaggaggaaggtgctttgttatgactacccatataatctcatagtcaatgttggcatattcatgggaaataatatttctgagtccaataacttttgcccatggaacttgtggataatctttgaaaaatgatctttgggttttatcatcaatagccttaattgtttctccgattacctgtattcgcataatgcaggcatccaaaacagtcattccccaaggggataacaagaaatcgtctacattctgtatattcttgcatctgtcttcaatgatagagattgattctgataattgaagaaacttatctagaatttcctctttaagcgtagattccatctttttctattctttgggatatgagtgaacgaaggtttttgcgtaaacggaggagatctattttgcaattacagatatgctccagttcttctttaatatcgaacatcacgaaaggatcgggttctttcaattctacgaaaacatctaaatcacttccttcgtgttgttcaccacgggcaacagaaccaaagataccgatagaaataattccatatttctcggcacactgttgcttgaattggcggatttttgtaaggtattcattcgttgttttcataattacatactcctttctctacaaaaatagtaaaaaacgggaagataacaagcgcatttctttgaaaaatagcttattatagaattgccttccgtgtttctataaagaagaatacagccattcctattataatgactcccagtatgccgtaaaagagccgcgctctgccgcggcctacattccggacgattgtctgtgcattgcgtgtggtgaagaaccagttccagttcagtaaggaagctagcagggaagtgattcccgctagcgcaaaaattccttgtacgatgtattgtccggtcatagtctgatcactctgcttccgtcttccagttcttcaatcgtcacttttacggcatctcccggcagtaattcttctaccagttccggccattcgataaagcaaagggcgccgctgtagaaatagtcttcgtatcccatgtcatatacttcacttagctttttgatgcggtaaaaatcgaagtgataaatcaattctccggtttcgtccgaacgatattcattaacgatagcgaaagtaggagaactgataacgtctgatacacctaattcctcgcaaagagctttgacgaaggtcgttttgccggctcccattttaccatataaagcgaaaacggtgttatcacccatagcagcgataaattcccgggctgcctcatggatactttccagtgattgaatcttgatttccatatactattctattattatgactgtttcttgcaacaactctttccgatcttgcaaatggcataaatcagaatagagaagaatataatcgaagcgcccgaagggactttccagtggtaagaaataaacagaccacccagacatcccagaaaaccgataccgatggacagccagatgattttcttgaaactgtaggtaaagaggttggccgtcatttgcggaatggtgagtagcgatattgcgagaacgatgcctaccatacgcagacaagcgacgatggtcaacgcaataaacatcatcagcacatattcgaatatctctaccggaatcttttgcgaacgggcaaactcgcggtcgaatgcaatatatacgataggacggataaacagataaaagaatccggttaatatcagagccaatatgcccagcatccacaagtccgcctgattgatggtcaggatattaccgaaaagataagctgacaggtccggagcaaatcccggtgacaggaaactgaacatgattcccaaagccattcccagcgtccagaatacggcaatcgcagaatcttcacgcatatctttccgccggctcagccactcgacaccgaatgcggacaatacagagaagacggcggctgagagtatgggagaaattcccgcaaacagtcccagtcctatccctccgaaagaggcgtgcgtgattcctccactgataaataccagacggcgggtaacaatgtaagtaccgataatcccgcaggcaatgcttgccagtaagctgcccagcaaagcgtgttggaagaatgtatatcgaagtagatccactttttaattaaagattaaagattgaaaattaaaaatcaaagcaagaataatgccgtccatcaataaaaacaacttcaacgccctcctaatacttattacttaatacctattacctctccccattccttctctctccgataatcagaaagacttcatctttgaggtcatccggcaactcgataccccgtagttgcaaactacgtacccagcctgcgacatcaatgtcctgcatggtatataacacatccctgaattggtttgtttcttcgtcagtatacgcatttgcttcctttccgatgaactgatccagttcttcgtcatcgtaatattcaatttttttgcttacggcggcaagcaaactatctttctcgcacacttcgtgttgtccgcagcattctatatctgcttctttcacttccggcatacggtccagttcacctttttctattttctgttgcagtcttttgttgcggatataaccggctatcaatgcgatgatacctagcaacaccaaacttataataagtatccacatagtctgtactgattcaattttctgcaaagttacttattaatttgcattctatcatggatggtatctatttcttttcttacttttgcacgttgctaacttaaatatatattagacgatgaagcataagaagtggttgactgtcttatttatacacggtaacaggagaagatatcaggtaagtatatgggcggaaggaaatggctgggtgatagaaaaaggtgcggattaaagaaagaaacagccggaactgtagggtaccgacaaaggtgattttcatctgcttaggcggttatttaaaataatcctgtatatttgtgataataaatcgaaagactatgatacgacgtaggctttgcctcttattcctactgactggaatgactctgtttgcttattcgcaaggattgttgtttcaggctaatgataaagaaattaaagaaaggacttctcttcagatatttcaggaaggggagataccttgttttacgaaaaactttcagttgagctttgaactttctattcgcgattttgatacttttggatatgtttttctgctgaaggaagatcaggggaaaactaaatatagctttacgtatacttatctggatggtgagaacagtacattcaagtttaataccgacggaaaagagaatcattattctttaaatctgcgcaatgatgcactggcttatcaatggattcctgtgtcttttgcattcgatttgcaacaggacgtacttacgattcgtatcggagataacgaaaagaagattacttctttaggattgaaagatactttttgtccgcacctcttcttcggacgttatgattatattttggatatgcccacttttgccatccgcaatctgaagctggaaggtgatagaagtcattcatatactttccctctgaatgaaaatgaaggggaagaagtgcatacttctacagggaaggttttgggtacggttgtcaatccggtgtggctcatcaacggttcttatcattgggagaaactttttgagtattcttttcagactccttcgggaatcacttttgagccggacagtcagcgactgattattttcagccaggattcacttcttacttataatctgttgaaacgtcagccacaaaagtattcttatagcaacaaactacccgtaaaattgcagttggctactcatttcatgaatacaacggatggtaaactttatgtttatgaattgaataacctgccgttgggggatgctacggtagcggcgctcgatctgaataatcaggagtggaaacagaccggagtagcagccttgccggtacagttgcaccatcatgacggcttttgggatgaaacaaccggaaagtatctcgtttttggcggttttggtaataagcgttttaataatacattcctcgaatatgatatcgaggccgaccgttgggataccctttcttattccggcgaccggattatcccccgttatttctcgggtatggtagtcaataagaaccgggagcgtatctatgtctttggcgggatgggaaatgaatcgggtgagcagagtgtaggccgaaattatcttcacgatctttatctgcttgacagaaagcagcagtctgtgcgacgtttgtggcagaacgcttcggatcatcgtttggtcgtcgcccgtgatatgatactgacacctgatgagaagtatatctatgccctgtgttatccggaatatctttcggatacctatctgcaactttatcgcttgacggttgatgatggaacgatgaaggctttgggagattccatcccgatgcgttcggaagagattatgacgaatgctaacctttactataattcattgacgcatgagtattactgtacaaccacagaatttgacaagaaggggcatacggtgattcggacttatgtgttgtccgcccctccggtttctctggatgaaatccgttcttacggctccaggtcttctctggagattcgttggttatggataatggcaggaataggagtattattgcttgtcggaggtgtgctgtttgtcaggagaaagaggggaaaacaaagaaatgcggttccggaatcatcttctgtgctcatgtcaccacctgtcggaagagaaccggataaaagtgtactgggaaaagaaatgcctgcaaaagaagattttgaatcatccatcgttcgtccgaatgcagtttatttattcggtccttttacggtaattgaccggaatgggcgggatattactcatttgttcagttcccgtttacggcaggttttcatctatatcttgcttcatagtacccataatggagtattatctgcctccttgaatgaggttttctgggccgataaacccgacgacaaggtgaaaaacctgaaaggggtaacgatcaatcagattcgtaaaaatctggctgaactggatggagtggaacttgtacacgacaagggatatttcagactggtgtttactgactgttattgtgattatttccgtttccgcaccttgaagaatgctgaagaggtggagaatgaactcggcattttattaatgcgtggcaaattccttgatggtatggatgcagggatgatggatcacttcaagcaaaaagtagaagagttcttgtcttccttcctgccactggaaatcgaacgtctgtatcagcagcataagtatgatgccgtcattcgtttctgtaatgtgcttttccgggttgatccggttaatgagctggcactggcctatggtatgcatgcccttaaccatacaggttcgtcacaagaagcgattctgcaatattccctgtttgtgcgtgagtacaggcaaatgatgaatgaagaatattctacttcttatgcagagctgatgagcaaaaatcctccttttcatcgataaaaacatatcggttaatgatatttattcgcttattaatccgttattaacccatcactaataagttgcttaacctcgctacattatgtttgcagcgatgttatttacttattgttttatttaaaaacctaatacgtatgaaaacaagattctttatgaaactttgtttattcagtttgttggtttggtgtatcagctcgtgcaagagcgataacggcgattcggtgcggcctattgcacttgaatgtatgtacacgcatctgaccgacatgacaaacatgcttgataccgcaaagatcggtacaagtgacggtactttcccattggcaaatgcccagaacctgcaaaaagctgtcgaagaattgcaaacaggtatttctaaaggtatggcaggctactttgttctacagtatgaaatagataactactgtatagccgccgaaaaagcgattgccgaatttcaggattcctatcaacagacattgcaaccgggtacgcctgccgaattaaaggtattcggtattgacggtaaagggcgtattgaatttggttccgatcctgcttatggtggtggtaatactttcaccgtagaaagctgggtgaagtatgatgccggtttctttgagtcgggaattggcagtttcctctctacttttgacggtaagcagccgaatgaaggatggatgatcaacttcttaggttcaaatcttcgtacaacgatcggtatgggaccacaggaaggccgcgtattggaagaaggccgcgcttatcctgataattttggtaaatggaatcatgtcgtgacggtgtgggataacaccttgtctgaaggacagttgaagatgtatgtcaatggtgaattattcttcagtaagacaaatgatgtgaagaatgatgcaggagtattacagaattatatgcctaatacccgtaaccagaatatgtgggcattccaggaaccgactgacaactcacgctgtatgaccggatttattaagaaattccgtatgtggagtactgcgaaatcggcgaatgaagtaaaaacgctgatgaactcggatgtgacgggaacagaaagcggactggtatgtgcatgggatttcacgacagtggccgaagacgttaccaacattccggataagacaggaaaacacgttgcgaaaattgtaggtaactacaaatggtttaaagttgagaactaaccttaataaacagacgaagagtatgaaaaataatacgataaaaataaaggctttcctctgcctgctgcttctgatgtgcggatgggtaagtgtgcaggcacagcaggtgcttacagtaaaaggtgtggtagtagacgctttaaaagaaccgttgcccggagccagcgttcaggtggtaggaatgtctaccggtacggtgactgacttggatggtaattttagtcttcaggttccgaaaggaaaaacgattgctgtttcttttataggatacgtgacgcaagaactgactgtaaatcagaatcagtcgaaccttaccattcagttgaaagatgattccaagcagttgaatgaagtagtcgttattggttatggtacggtagaaaagaaagatttgacaggttctatccaatccgttaccagcaaggagttaagtaaactggtgactaccgatgtcactgaaacactgaacggacgtgtcggtggtgtacttgtgaacaagacttccaatcgtcccggttcggatacgaaaatagagattcgcggtatcaactcgttcaatttctcgaatgaacctttgtatgtgatcgacggagtaccttctcaaacgggaatgcgtcatctgaactctgccgatattgaatctatcgacatcttgaaagatgcctcttccagtgcaatctacggttcgcggggtgcaaacggggtggtgattatcactaccaaaggggctaacaagcgtcagggctttaatattgactattcgggttacgttggtttcaagactcctacccgtattcctgaaatgattggtaacatgggcaatggactggaatatgtagactatcgcaccgctttgtggaaaaagaagtatggtgatgcttcactgagccgtccggacttcctgactgatgatgagaaacgccgtatcaaacatggtgaatactatgactggttgcgtgaactgtcgcagaatgcattgactaccagtcattctgtttccgctaccggaggtacggacaaactctctttctcattcggcttgggatacttgaaagacgacggtatggtaggcgatgaaagttttgaacgtattactgccaatatcggattggaatatcgcttctctgataagttcaaaacaggaatcaacagttatgtttctttgaataacacgaatgaaggagccaatgatgctttgattaatgcatacttcctgcctcctacggtcagcccgtacgataaggacggaagctacctgtttaattgtcagccgacttccagcaagatcaatccatttgttcagattgaaaataataaaagagagaaagaagcaaactataccaacttctccggttatctggaatatcagccgatcaaaggactgagctttaaatcgcagattgcggttcagtatgattcggacgtttacggagaatgggtaggtacgatgacacaagccaaaggaggtctcaatgcaccggaagcttaccggaaagaaggacggaatatgaactgggtatgggacaatatcattacttatgataaaacctggaagaatattcatcgtctgaatgctatcggtttgtatagcgtacagaaagaaactcataagggttcggaaatgcgcggtgacggtctgccttacaactcggactggcatgcgatcgaaacagccgaagaaattcgtgatgtgaagagttactattgggagtcatccatgctttctttcatgggacgtgtcaactatacgttgatggatcggtacttgtttactgtaacaggacgatatgacggaacttcccgtctggctaccggcaatcagtggggatttatgccgtcggcagctgtcggctggcagatgaagaatgagaatttcctgaaaaacgtagactggctgaatagtctgaaactccgcgtcagctggggtaaatcgggaaataacagtattgaccatgatattacctggacaaagctggacctgactcattatatctatggaggtaaaggtgaaaatgctttcggattaggcgaccgcaaaggtaacaaagaccttcgttgggagatgacttcggagtggaactacggtattgatttcggtttcctgaataaccgtatcaacggtacgattgatgtgtataaccgtacaacaaaagatttgattttcgcccgttcggtaggtaacctcaacggttatggctctatccttgagaatataggaacgtcctccaataaaggggtggaaataggtctgaacacggtgaacgtctcaaagaaggacttcacatggaagacaaatctgactttctctctgaaccgtaataagattgtagacctctacggtgataaaaaggatgacttggctaaccgctggttcatcggtcagccgatgaaggtgatctatgatctggaaaaggtaggaatctggcagacggaagataaggaactggctgctaaatacggacaagtgccgggacatatccgtgtagccgatctggacgagaactatgtgattgatgaacgtgactataaagtactcggttctccgtcacccgactggacagcaggtatgaccaatacctttacttacaagaactgggatttgtctttctatatgtatgcacgtatcggtggtgtctacaatgatgacttcacttatatgtttaccgcatgggataatgaacactggaacaaactgaatgtgaagtactggactccggaaaaccacagtaatgagtaccagcagatcggtgcgcaatcctaccatactcaggtattaggtaagatctccggttcgttcctgaaaatacagaatatcacgttgggatatacccttccggaaaactggatgaagaagatgaagatgaaaaatgcacgtgcttacatcaatgtgcagaatccgtttactttcaccgactatctcggtccggatcccgaaacgattggtgaagacgtatataagtctttgtcgctttatccgatgacatttacttttggagtgaatttaaccttctaaatgcttgaaaccttatgaaacgagtaaaagaacaaattaaatatttggcactgttagcaatctgtttgctaagcggatgctccgattttctggatagttataacccctcggcagtaacggacgatttctataatactaaagaaggacaaaagaaattgttgacagatatcaatgcccgttaccgcaatgttttcaatacaggcgaattgcagtattacggaactgatatctacatggctatttccgaagaacctgccgaacgtatgtttaacggctatgacaagactttcaactccactgctccgattgtaggcgattattggaaagtactctataagattgtgcaggaaagtaacatcttgctgaatcgttgcacaccggatattgcaggaaacgattatacttcgctgaccgcacaagcccgctttttccgggcgatggcttactattatctggtagaaacattcggtcccgtacctttgctcaccgaagagaatacaagcgttatccagcaggcggaacgtaccggtgaacaggctatttacactttcatcattaccgaactgaatgatataaaggataaactggacatgaccacgatttctgccggaaaggtaacgaacgccgcagtcattcactttttagggaaaatgtatctgacacgtgcttacaaatcctttgctgaaacagacgacttctccaatgcagcaacgacatttgatttgctggtagagaatccggcctccggttatgctttgcaggaaaactatgctgctttgttcgatgaaaacaatcaggctaattcggaagtaatctgggcgattcaatatggactggataagaactatcggggtgatggaaatccgcaacaggcacagttcggatttaatattgtagcattggagccggatctgttcattaagaatcagaatgattactctagtgtttcccgtaaatactgggtgaatccgaaagcgcacgagctttatacagacccggaagcggatacccgttatgatgcgacgttcaaacgtgaatattacataaacaatccggataatgctgattacggtaagctgggaatctatttcccccgttggaacgataaatcgggtatgagtaataatgcgaaaaggttttatccgttcaagcaggacgatgaatatgtgtggtatccgcaatctacggcacttcctgtattagaaactgcttcagatcgtatgccgatggtacgtaagttcagcgataccaagatacaatggggcgaaggcggttctcgtgaagatgtcatttttcgtttgggcgatacctatctgttgtgtgctgaggcttatctgggtgccggaaacaagaaactggcattggaacgcatcaacagtatacgtaagcgtgccgctaaagatgcgaccgcttatgaagcaatgaagttgacggatctggatataaatgttatcatggatgaacgtgcccgtgaattgatgggagagcatgaccgctggtttgacttgaaacgtactcagacactgctgacacgtgtacccgcatacaatccgtttgtggtgaaatatgataatttgaacaagaaccatctggtacgacccattccacaagatgaacggaacaaggtagatggattatctcagaatgaaggttattgattaatggttaactaacaaatgaaagaagtaattatgaaaacgactatatgtggcgctgcactgttgctcagcttgacaatggctagctgtgaagtgtacgaatcgccggaaatcaatcaaggattgaacgaagaaaacaacacgtccctttatacagatgcttatgatccgatcagtaatgtgggtcaatactatatgccggaaatgaaggtgaaaccgaagaaatactggaattgtgtggaagtcgtaacggtaggcagccgtaatgagctgggacaaacagagaaagtacgcggattacagtaccacctgatgtgtcagtcattggccggtctggctaatcgtgccgtagaacagggaacaagtgaaatagctgtttggctgcacgatcacggtggtagtgattcctataaactgtctaagcaggcactcgaagatatgggtatccacgaacaggggatgcagagcggactggaactggcacgtaatgattatggtccgtccgatggagtgactattcagctgaaaggaatgttcgacggatatgtattgacggatattgagcataatccggagagcggtgtcgtagcatctgttgcttctcatgtttataattctattattgtggatgtccgtgacaaggaatattatgaagaagcaggatataccatgaaatatgatgcaagaagcaaaactactgcacaggcatgggcggagttcaaagacaagtgcagcaacaaagcattggtgattatgcctgtacaaaccggtgaattgcgtgagtttgctattaagaatgaacttttcgtattgaacttgaataagcgtcagggaacttcgatagccggacaaaacacagctttgctgaaagaaatccttgcctggctggaaccgaatgcacctgtctacggatgggaacagggagtaagtgaagatgcttttgtcgatttggtttccaaaagcggtcatccgatgatcccttgtgactggagttacaatcattccttgacttcattgctttattctcaacgtcagaaatcgacattggctcgcgtgaagaatccgcagtttctggattatacaaagaaaaagaatttcgtttctttcttcctttccgatggtgacaatattcagtggatgatgaatgactttaaagatttctataatgcggcggagtcggaagaagtacggatgacgtatggtattgctgcttcagtgcttccgatgatggcaccggcacaattcgataatctgttgagtcagcaaaaaccgaattgctctattttggaaatgctgggaggcggttactattacgtagacaattatagcgagaatggcgaccgggcgaagaatctgaaagtcgtggcagaacgcctttcggctcatatgcgtcaacatcgtgtgaaactgttgggtgtaatggctatgaacgtaaaatcagaggctgccaaagaagcatttcaggcttatgtagatgccaatgaccagttggaaggtatcgtagcgcttcagtatagcccttatgcaggaggtgaaggagacgttatttgggtaacgaataaagcagggtatgatatcccggtcattacggtgaaatactctttgtggaattttggaaaccggaatgcagaacgtgaaggtacccctgcctatattgccggaagattgaaacaggaagcacagcaggaaagtttttctgtcgtatgtgtgcatgcatggagtaatttctccgatcacggacagacggaagatccgctgattgagaaccagtccggggatattcgtggagccggagcggcaaagctttgtgcaggacatctgaacgatagttttgaagtagtaaatatgcaggaattagtctggcgtttgcgtatgagccagcgtccggaacagacgaagaagtatctgagtgaggtattttaattaacctgagtttcacaggctttctgcatggttttctctgttttaacgtggcaggagaagtgatacagaaggcttgtgaaacttaagcaaataataatagatatggttacaagattgtttttcttatcaatctgttttccttttctgctcacttcgtgtcagcagtcaaagaagacggtagagtttgtagactacgtgaatcctttgatgggtaccgagtctacttttgcgttttcgcatggtaatacttatcctgctgtggcggtaccttgggggatgaacttctggagtccgcagacgggggagaatggcagcggatggatgtatacgtatactgacagtctgatgcgcggtttccggcagacacatcagcctagtccctggataaatgactatggtacattttccattatgccgcttgccggagaactgaaaatgagtcacaaagaacgtctggttccgttctcacatcaacaggagaaagcgactccttataactacagtgttacattcaataacggattgcagacgtctctttctgctacttcccgcggagctgtattcgaggtctctttccccgaaaaggaagatcagtatgtagtggtagatgcatacaacggaggaagttcaataacgattgaaccggaaaaacggttggtaaaaggtgcgacacgttataataacggaggtgtgccggataacttcgctaattactttatgatggaattcagtcatcccgtcatagaatacggtacttacaatggagatactttgttgcaccatcaaaccgatgtagcggccgattatacctgtgcctatctgaaatttgatgttccggcaggtgaaaagctgaccatacgtacagcctcttcttttatcagtcccgaacaggctgccatcaactttaatcgtgaagtagctgatgcggatgtacaactgatcagcgggaaagcccgtgaacagtggaataactatctcggacgtgtagaagcggaaggaggaacagacgaacaacttcgtaccttctattcctgcctgtatcgtacattactttttccacgtgagttctatgagtttgattcacaaggaaatcctgtttattacagtccttatgacggtaacgtgcatgatggttatatgtatactgacaatggtttctgggatacgttccgtgcggttcatccgttattcacattgctatatccggaagtttcggaacgtgtgacgcaatctatcattaatgcttataatgaaagtggctttatgcccgaatgggcgagtcccggtcatcgtggttgtatgattggcaataactctgtttccttattagtcgatgcatggatgaaggggatacaaacggtagatgccgaaaaagctctggaagcgatgattcatcagacacaagcccgtcatgcggaaatagcttctgtagggcgtgacggcttcgagtattatgataagctcggttatgtaccttatccggaagttcccgaagctacagccaaaacactcgaatatgcttatgctgactggtgtatcgcccgctttgcgcaatcgctgggtaaacaggatatcgcagaccagtattatcagaaagcccagaattaccgcaatctgtattatccggaacatggttttatgtggactaaggatgccaaaggcaattggcgtgatcgttttgatgctacggaatggggcggtcctttcacagaaggaagttcctggcactggacttggagtgtatttcacgatccggaaggtttatctgaactgatgggcggacatgaaccgatggtagcccgtctcgactctatgtttgtggccccgaacacttataattatggaacctatggtttcgttatccacgaaatagctgagatggttgccttaaacatgggacaatatgcgcatggcaatcaaccggtgcagcatgccatttacttgtatgattatatcggtcagccttggaaaacacagtaccatctccgtaatgttatggataaactctacaattccggaagtaaaggatactgtggcgacgaggacaacgggcagacatctgcttggtatgtattttctgctatgggtttctatccggtttgtccgggaatgcctgaatatgcggtaggttctccgttatttaaaaaggtaactctgcatcttcccgaagggaaaaacttcgtcgtttcagcagcagataatgcggcagaccgtccatacataaggaaagctctgttgaatggacaagaattcacacgcaactatctgacgcatgatgaactgaaacagggcggagaactgaatctgtcaatggacagcgtaccgaatcagcaaagaggtacccaaccggcagacttcccatattcttattccaagtagtttcaataggttttagtatacttttcattgaccgatacggagagaatcttaattgatttgatctgtatcggtcatacaataggaatttaaagtcaggctttgtctttgctgtttcttttgttacctttgtgcatctaatatgaggtttatgatacattctcttccatcttccgaacccttgacggcacaaaagcttttctcaaagctttatgtttcctactatgcccgtttggttcgtttcgcttccctttatgtaggagctatgggagacgcagagaatatagtacaagattttttcctctatttatgggaacgtaaagagatacttccggaactgcaacagcccgatgcatatcttttctccgctgtcaagcatcgctgtctgaacttccttcgttcacaactttctatagtagaccgcaggcagccgctttctgatattatggagcaggagtttaaactgaaactttatagcctgcaactacttgatgactctcaaatgtcgatagatgaagtagaaaaacagatctgccgtgcaattgatagcttaccggaacgttgccgggaaatatttgtcatgagtaagctgaagggtatgaaatatcgtgaaatagccgaatcccttggcatttcgcagaatacggtagaaggtcaaatggctatcgcattaaaaaaacttagggaagagttgcgtcattgtctgcctttgctgcttctattgagcgtataaggataaatcgcctatgtattgtctttgcttcagtccattccatatactttagtcaagctgagtactaatttgcagcttataatgaatgaatttagttccggttgcttataaatctattcgtctgacagttgttgaactttcgtctgacaattgttatcttttcgtctaacaactgtcagacgaaagttcaacaactgtcagacgattaaatttaagtataatgaatactaaatctgtgtacatcaagaattaaatcttagagtaaatccgaacagattagttcgtttcaaaacagttcttagcttaaacttattggattttacttcccttccttgattttttttcattttcctttggtggtaaatgtaagttgctgtgtcttcttattaaaagcgcgcaatatgatgaatgagaaatggaatcaatactttttcggagaaccgaccgaagaggaaaaacgggagctttttcaggaactggaaaagaacgaagatatgaaacgggaatttgcagaaatgcaaaatatcgtaggtctgtccggattattacccagagaagatgattctttgaaaggcgaacggaatctggaagcaatgatgaaccgtcaggagaaaaagctgaggcggaaacgggtgttgcaaatcgtgcggtatactacttcggcagccgctatgattgctctgacgtggatgctcgcctggtatatgtttgttggctcggagactccttcttatacggagattacagttccgaaagggcaacgggtacatttaacccttccggatggtagtgaggcatggttgagttcgctttctacgttgaagtggccttctgttttttcgtccgatgcccgtacggtagaactggatggagaggggtttttcactgtgacaaaggatgcttcccgtccttttacagtgcagacgcagaagtatgatgtaagagtgcttggtacggaatttaatgtgtatgcttatagtaacagtgagaagtttgagacagacttgctctcgggtaaagtgagggttagctctaccggatttccagaagaatcggtgaatttattgcctgacgagaaagtatctttggtagatggaaaactggtaaagtcttcttctcattttggaggaaaggaatatcgtgaacaaggaatttatgactttgaagaattaccgttgggcgaagtgctggaaagattggagcaatggtatgatattcattttactgtagatgatccatctctgttgagtaagattatttcgggtaagttccggcaaagcgatcagattgaaacgattctgaaagcaattagccgtgcggacttatttgagtacaaaatactgtcacagcgagagataacgatatattaataatctgattaaaatttaatgcctatgtaacacaacggagtagaataaaacgaaagtaaatagacatcaaaatgaggaataaaaagggggaaagtggtgcaacactctccccaattcctcagctattaatactttctctgtttcacgtttttgtgaacctaaaataaagtactaacaaaaccacttagcaaagttatgaaaaaaatcttttcactgctcgctttggtcctgtttattaacctttttacataccaggcccaggcacagacagcagttgtgaatattaataaaacttcggtttcgctaaaagaactgattcaagaagtcgaaaaacaggccggatatttgtttgtctacggaaaagacatcaatatcgaacagaaagtaaaaatcaatgcccggaataaacaggtaaaagcattgcttgaaaatgtattgccgcaaatagggctgacgtatgaatacgccgacaactacatctcattgaagaaaacgcaggtagagaaaaaatcaataggtaaaaaaataatagtcaaaggaaccgtagtagacaaaagtggcgagcctattatcggagctaacatcatggagcagggaagtgcttctaatggtacgatcacagatatcgatggtaaattcacgttatccttgccttccaattcggtattagcggttacgtatgtgggtttttccacaaagaatattccggtgaacaatcagaatgccattcagattgtgatggaagaagattctgaaattctggaagaagtagtggttgtggcttacggtacgcagaagaagatttcttctacagctgctgtatcaagcatgaagactaaagatgtagcgcaaaagccggttatcaatatttctaatagtttggcaggtcgtatggcgggagtcattgcaaaacaaggatcgggagaaccgggagctgatggttctgatttgagaatccgtggtgtggctacattagggaaccaatctccattggtcgtagtggatggagttccccgtgacttttcacgtatcgatccgaatatgatcgaggatattactatcctgaaagatgcagctgccgtagctccttatggtatggccggtgccaatggggtagtattggtaacaacaaaaaagggaaaaagcggtgctccggtactttcatacaatggatatatcggttttcagaacccgacccgcatcactgaccaggttaattcgtatgaatatgctttgatgaaaaacgaagcggctatgaatgcaggttatcccaattattatgcctactcacagcatgatctggaaatgtaccggaaaacctgtgccggagaccccgatgccgatcctgaccgttatcctaatagcaacggtctgcgtgacttggtacaaaacaattctgtgattacgaatcacaacttgcaattatccggtggtagcgataaattccagtactacgtatctttaggatattcttatcaggaaggaatgtggagtactaccgattaccagcgttttaatctgctggctaatttaagcgtggatgccaccaaatatacgaaaatcagtttaagtctgggtggatggcacgaaaagaagaattatccgggtgccgatacaggcgacatcatgtatcaggcatatcgtacacctcctatctctgctatacagtactcgaatggtctgtggggacaatatgtaggtaagtcacttttcgggctgacctatcgtagcggatatcgtcaggagccggccgaccaactgaatacttctctctccatagagcaacagcttcccttcattcaagggttaagcatcaaaggagtaatcaactacgatccgtatcgtgtgaagaaaaagaaatatctgacaccgatacctgtatacacactggatgcatcacaaactccgtatcaattcgtggaaggattccagggaccggagaaaccgaatctggaacaatcgtttgaagaaagcgtgagcatgacttatcagggaatgattaattactcacggactttcggcaagcatacggttactggactcggagttattgaagcacgcgaaagaaacgtatggaatatgagtgccaaacgtctgaattataatattaacatagatgaaatcaatgcgggaagcagtgaccctgccgatatcagcaacggtggtacgtcttggaaagaacgtcaggtaggttatgcattccgtttgggatataattatgataaccgttatatggcggaagtttccggtcgttatgacggacactactattttgctccaggcaaacgttttggtttcttccctgctttctcactgggatggaacttgcgggaagaatcctttatgaaagatgtcgaatggatggataaactgaaattgcgtctttcttatggtgagtccggaaatttggctggtagttcctatcaatatatgagtgattacggattcggaaacgctgtaaactttggcggtgtacctatgatgggtatgtgggagaacttgcaggggaacccgaacattacttgggagaaagctaagaagtttgacttcggtgtggagttttccgtattgaacggtatgttttctctggaagctgactatttctatgagaagcgttcgaatatgctgatggctccgaatgcattggttccggcagaatatggtattcctttgtcacaggtcaatgcgggaagtatgcacaatcaaggtattgatttatctctgaatttcaacaaacgtatcggcaaagactggatgatcagtgcaaaaggtactttcactttcgcacgtaatattctggatgaagtatttgagacggaagccacctttaataatccgaatcgtcgcagaacaggacgtcccgacggaacaatgttcggatacaatgctttggggtactttacttatgacgacttcaatcctgacggttccttaaaggccggcatcgctactcaaccttggggacaggtatatccgggtgatttgcgctacgaagatttaagcggtcctaacggcgtgcctgatggaaagattgacgaacacgaccagacagtgatcggcttctctaactgggcgcccgaaattattttcggtctggctcctactgtccaatggaagaacttcgacctgaacgcattgattcaaggggctacccgtaccagtatctcattgggtgagactttggtaatgcctttctttgattccggttcggctactaagttacaattcagtgatcactggacgccggataacacgaacgcaccttatccccgtctgaccagtgaagtaacggtgaataaccatcgtcaaccttcttcgtggtgggtacgtgatgctacttatatccgtttgaagagtattgaaatcggttataccttgcctcgttcggcactgaactttattggtatcagctctgcccgtgtatatgcttccggacaaaacctctggacatggactccgtttatgaaagagctgatcgacccggaagccaaatccgctaatggtaaatactatatgcagcaggctgtatatgcttttggtttgaatattactttttaattagttaaccatcataacaagatagaatatgagaatacataatataataaaaacagtttgcctggcaggctcattagccttgctgtctgcctgtgaagactggcttgaaatagagccgaaagaccgttttggagatacaacggtctggggatcggaagaaaatgccgatatgtttctgaatgatatctataatcagttgccgcatctgaacaatgaaacacagaatctggaccaatattcggataattcatacgtaggtgcggaatggatgaatgcccgtacaacgatttataccggagcattatctcctaccagctggatacccggcccctgggatatgtggaaatggggacgtcagaataatgacgacgccaaaggacagtatgagcgtatccgttcctgcaatcttttcattacgaaagtaacagaatccgatttctcggcagaatataagaaagaacgccttgcagaagtgcgtttcctgcgtgcctggttctatcactatctttggatggcgtacggtggtgtgcctatcatcacggaagtgctggataataacgtgagtacggatatcttttatccgcgtgagactgcacagaaaacatttgagtttatcgacaaagagttggacgagattaaagatgatcttcctccgcgccgtagcggttccgatctggggcgtgcttccaaaggagcaattctgacactgaaaggatgggtggaactgtttcatgccagtgaattgcgtaatccgggcaaagacaagaaacgctgggaagcagctgcggctaccttgaaagatgtaattgacttacaggtctatcatctgcaaccgactattttggacctttggacagaagctaccaacaataacgatgaagtgatcttcgacttccagatgtctaagcagaatggagggcgtcgtgaaggtctgttcggtccggtgtttgtaaaaggagtacagtccagttggggaaatatgcagcctacacaggaactggttgacgactattgcatggccaacggattgcctatcactgatcctgcatccggttacaataagaataatccttataaaaatcgtgagaaacgcttctaccagagcatcctgtatgatggatctatgtggcagggggaagagattattactcgtgtaggagtaggtagtcccaatgagattgatacttcttcggatagtgacgttacgaatacgggatactacactcgtaaaacgattgatgaatccgtgaatggagcggacaatctgcaaatgagcaacggaatggcaaattatattttcttccgttatgcagatgtgttgctgatgtatgcagaagcttctttggaagcgggagataaaccgactgccatcgaatatctggatatggtgagaacacgtggagataatatgccttctatcggcgatacttatccgcagggaatcacagaaaatcagttgcgggaaatcattcggagagatcgccgtatagaattggcatttgaagataagcgttggtgggacattcttcgctggaagatttgtgatggtgaaaacggagtgatgaataaaccgattggtggtatgaagatagaagataccaatggagatggtgtgtgggaatacaattatcatgaagttggtaaacgtaccttcctgccacgtatgtattatcagcccattccgcagtatgtgatagacaagaatccggtgatccgcgagcaaaatggtggtgaagacggatgggtaaacgggcagaatcccggatattaataaagaatgtaaaccttgaaagattattcgtatgaaactaaatagatttgtcatggcggcaagtgcggtactttgttcgtttgccttgctgagtggatgtagtgatgatgatgtttgtaaagtatatattccggaagccaaaactttgcagattaaaaacttcgatttgggtgaagaactgagagaagtatttcatgtggctgtgactgccagtgactatgtgacccgttccggtaaggaagtgggaggagatgtaaaggtacagttgactgtggatgaggcgaaggtgcaggagtataattctttgtgtgggacagactatcctttgcttccttccgattgctatacgctgacaacagaaactgtgattccggccggggagagttcttctgccgatctggtgcttacggtaaatgcacagggaaaaatccagccgtttgattcttatttgttgccggtcactatcacttcggtagaaggtgcgcaggcggatcatattcagcagacagtatattaccttttgagtggtgcggaggatgtatgggcgatgccattggccgaccgcagtgcatggcaggtagtagaagtttcttcggaagagacgagcggcgaagggtcggataacggtcacgctatccacgcttttgacggactgaaaggaactttctggcatacacaatggaaaggcaacgagcctcagccaccacatcatatcgtagtagatatggggcaggaagtgaaaatgctgggctttcagtatgtatccagagatcatggtgaagcatggccgcaggagatgacgatggaaaccagtctggatggctcgaagtgggagtcggcaggaacttacagcgaccttcctgcgggggcaaaagaggaattccgttcctattttccgggatttaagcaggcacgttatttccgtctgacaataactgccgtgtatagtggcaaatgggcaacagcggtagcagagattaatgcgatttctattattaaataacagaaaaaacgattaccatgaaaaaatacatttatatacttttgacgttctgtctgttaatctcctgtatggaagatccgacggcaggtgtggtcgttcctaaatatactccgtctaccgagaatccgggaggtccgggtgaagaaccgggtgatgggctgatagatccggcagaaccgctggacaggggatttatgcatctgaaaggtcgtgaactgaaatccctgaattctatttccatcacaggactgaatgatggcgagaaagtaattctttccactttggcagggcttgcggcaagagtgacgggcgatcaggtttatatcaatgaaggaggtccttcttccgtatggttgaagcagatgcagaataagtacggaattccggtaaatacttataatgctttggctccgttggtacagcattatgtagaaaccggagtgatcaaggggtatattgtctatacgccttattcggaaggacaatctcattcgatcaatgtagctacttctttatgtgggttgcttcgggggattgcggtaccggaatctcttgtcgataaggtaaaggcaatgggagtgacaaccgaacttatggacgtaaggtcttatgatgagaagtggttgtacgagaattataaagaccagttggacaagagtcttgcagccgatatgaaaccggaaatcttccatcacctgcgcgattatatcacaatgaccaatgcttttgctttttatgactacaatgcgcgcagggattggtcatggcgtacttctatactgaaagatctggataaaggagcttattgtttcggttattatgatctggatgaatggggcatggtgaataatgcttctcaattgggtgtttctatgttgccgaccgatcaggcggctaatctggccacgttgagtagtatatatgatacaacaggactgaaacagcgtccggcaactaaagaagtggttaccgaagagaatgtgcactatgtgacattcctcgtcagtgacggtgataatattgcgtttaacctttggggcaacaaggatacatggatcatgacctgcacggtcaattcccactcggatataccatttcaccttctctgtacgatttggctccggctgctttacgctggtactatgagaatagcaaagaaggcgattactttgtagcgggtccgagtggcagcagctatatattcccgagtaagatgtcggatgccgacctggacgattatctggctaagttgaatgagtatgtcgataagtcaggcttgaatatctgtaatattctggatcagaagattatggataatccgaaagtttacaataagtatctggctcagcctaatatcgatgcgattttctacacaggatatggagaaaaaggggatggaagaatcaaattttcggataatggcaagccggtgattgagcagagaagcgtattatgggaaggcatcgacggtggctcgaacagaggtgaagaatcgactgtcatttctcagatcaatagccgctctgccaatccgcatagtgccgacggatatacttttgtatttgtacattgctggacaaagaaccagcaaagtatcaaaaccgtcattgatggattgaatgacaatgtgcgtgttgttccggtcgatcaattcgtgcagctggtgaaacaaaatctgggtcctaaataaacgaatatactcgtaagttatttattatgaacataaaagtattagttgcatcggcagttgctgcattcagttctctgccggtcatagctcaacaagcaccagctccttgcgggttggttccgagtgcccgtcaacttgaatggtacaatcgggagatgattgctttctttcattttggaatcaatacatttgaagaatatgtgaatgaaggtgacgggaaggcaagtacggcaattttcaatcccacagccctggattgcaggcagtggatgcagacattaaaagcagcggggattcccgctgctattctgactgccaagcatgccgacggattttgcttgtggcctagcaagtacacagattatagtgtgaagaatgcagcgtggaagaacggtaaaggagatgtagtccgcgagtttgtcgatgcttgtgaagagtatggattgaaggcaggaatctatctgggacctcatgaccgtcacgaacacctttcacctttatatacgaccgaacgctacaaggaatattatgcccaccagcttggcgaactgatgagtgattacggtaagatatgggaaacatggtgggacggcgcgggagccgacgaattgacaacgcctgtttatcgtcattggtataagattgtccgtgaaaaacagccggattgcgttatcttcggtacaaagaattcttatccgtttgctgatgtccgctggatggggaatgaagcgggagaagcgggtgatccttgttgggcgacgactgactcagtagctattcgtgatgaagctcagtattacaaaggtttgaatgagggtatgctggatggtgatgcgtatattccggcagaaacagatgtttcaatacgtcccagctggttctatcatgccgaagaggatagccgtgtgaagagtgtccgtgaactttgggatatctactgtacctccgtggggcgtaatagtgtattgcttctgaatttcccgcccgacagacgtggtttgattcattcgaccgattcgctgcacgccgccttgttaaaacaggggattgatgagactttcagtacgaatctgttgagaggagccaaagtgaaagcgaccaatgtacggggtgcaaagtatagtccggaaaaaatgctggacaatgagaaaaacacttattttgccggaaaagacggagaggtaaaagcggatataatttttaccttgcccaaaactattgagtttgattgtctgatgatcgaagaagttatcgaattgggacatcggacgacgaagtggagtgtggagtacactgttgatggcaaaaactggatcaccattccggaggcgacggacaagcaggccattggtcataaatggattgtacgtctggcaccggtgaaagcaaagcaggtacgtttgcgtattcaggacggtaaggcttgtccggctatccatacttttggcgtatataaacagtcaccggttttcaaattataatataaattagactactaaatgatgcaacgattaaaaatcttgggaagtgcattgattgcactgtcgttttccgcctctgcggttgtggcgcagcagtttgatccgaagcaaggatatgaaatccatacggtcaacggattagtgctagacaatcaggagagtctggatacgaatacgaaaatatttatcagtaagcgggaggcagacaaagaatcgcaggtctggaacctgattccatgcgaacaagagggatgctatacgataaccagtcccttgactcaaatgaatgtagataatagtggtaaaggaaaagtagaatgttccgtgattcaatggtcggcagaccctaaaaatccgaaccagcaatggaaaataacggctttgccgaatgggaattacgtattaaccaatgtcgggactggctataacttaggatttcctgatgccggactggtcggagagcctgtctttcagttagaaccggaagcttcgaaaagtaaccagcagtggcagatacggaaatcgaacctgaaagtagtggcggaagccttgaaaacaacgagtcataatgactgggaaaatgaacgtatctatgcaatcaataaagaagaaggcagggctacatttattcctttcgccaattcggaagagatgaaggcggatcccgcttatacccgtccttgggagcgtacccgctcttcccgttatctgctgttgaatggaaactggaagtttaactgggtgaaacaaccttcggaacgtccggtggatttctataaaacgagttatgatgtctctggctggaaagagattcctgttccctccaactgggagatgcacggatatggtacacctatttataccaatattacttatcccatccgtaacaatcctccttttatacaggggcagcgtggatatgctgtagagaaagagccgaatgcggtaggatcttatcgccgtgaatttgctcttcctgccgactggaaagacaaagaagtctttatccatttcgatggaatttatagtgcagcttatgtatggatcaacggtaagaaagtcggttattcgcaagggtccagtaatgatgcagaatttcgtatcactccttacgtcaaagcgggtaataatacggttgccgtagaagtttaccgctggtgtgacggcagtttccttgaagatcaggatatgttccgtttaagtggtattcatcgggatgtttatttggtagccagtccgaaagttcgtctacgtgacattcacctgacttctcagatcagcgaccgtctggataaagcggaactgaaagtgaaaacggatgtgcataattacggaaagaaagtacaggaagctaccgtacgtgtctctttgctgaatacggaaggaaagcctgtgagttcgtttatcatacctaccggtaagataactggtggacaggaaaacgtctgtgaaggtacgactacgattcgcgaccctcggttatggagtgctgagactccttctctgtataccgtccaactggaactgcttgatgccgcaggcaatgtgcttgaagcgacgagccagcaatatggtttccgtaagatagagatccggaataataaggtgtatatcaacaatgcattgatcctttttaaaggagccaaccggcatgacatacatccgcagtttggaaaagctgttccggtggaaagcatgatagaggacattcttctctttaagcgtttcaatctcaacacgattcgtaccagtcattatccgaacgatccgaagatgtattcgctgtatgattattatggcttgtacgtcatggatgaggccgatattgagtgtcacggcaatatgtcgctgtcaaaccgtgaaagttgggaaggagcttacgtcgaccggatggtgcgtatggtggaacgggataagaatcatccttcggtcattttctggtcaatgggcaatgagtccggtggtggtcgtaactttgaggctacctatcaggcagccaaagcgatagacgaccgttatatccattatgaaggaatgaacgatgtggccgatatggattcccgtatgtatccttcgattgaaagtatgatcgaacaggacgagcaaccccgtaacaagccttatttcctttgtgaatatgctcatgcgatgggcaacgccatcggtaatctggaagaatactgggattatatcgagcatcattcgaaacgtatgatcggaggatgcatctgggattgggtggatcagggcattaatatgcccggacagcctgccgatcattattattttggaggcagcttcggtgatcgccctaacgacaatgatttctgttgtaacgggattgtgacggctgatcgtcaagttactcctaagttgtgggaagtgaagaaagtctaccaatatatcacattggaaccgaatgctgaaaacagtatcggcgttcgtaaccgctatgctttcctgaatctgcatgattttaatctgcgctatgtgattttgaaagatggtgtgccgatagcggaagaagagttcagcctacccgatggtaagcctggagagcatcgtgcggtgcagataccttattcccgctatttaacttcagaaggtgaatattatttgaaccttgaaataaaactaaagaaggattgcgtatgggcaaaagccggacatatcgtagctacggaacaacttttgcttcaaaaatccccgaataccgggctacagccggtagcagtttccgcctcatctaaagaatctctgtttaaggtggtggaagaggagaagcgttatttgttcttccgccgtcccggtgtagaaatcacctttgataagaaagaaggcaagttgaccggtatccgttataatggcgataatatgcttcatctgcgtgaaggatggtcgctgaatacgttccgttttatcaataacgatgtgcgtaaatggcaggatacccaaacggaggtaatcagtttcgactggaaatggtcggaagataatcagtcggcaattgtaacgattcagttgcaggaaaccgtcggagatgtgaaagtgccttatacattgatttaccgtttgtatggtaatggtgaaatagatgtggatgcttcttttacaacgaatgatgactttaatcttccccgtctgtcgttacaggccttctttaatccttcgttggagcagttggaatggtatggtcgcggtccgatagaaaattatcgggatcggaagaatgcggcttatgtcggcaaataccagtctgctgtcaatgatatgaaagagagttatgcccgttctcagacgatgggtgggcgttgtgatacccgctggctgactttgaccaataaagcaggtaaaggaatcaagattactgctgccgatacatttgatttcagtgctttgcactatacggataaggacttgtttgaaatcaagtacggtcatgccttgcctgatatttatcgtgcggaggtggtgctgaatctggattgcatacagcgtggtctgggtaatgccagttgcggaccgggtccccgtcccgcttatgaaattcagaagaatacagtttataaatatgctttccgcatgtctcctttttcaaaataaggaaagattgacaggataacaaggtcttaatagtttgtagaaagagtgagcagccaaatcttataaaagatggcaactgcttactctttttttgtatttaaggatagattctgtgttcttttcgtacttttgtaacatggactctaaattatataccacgatgaaacaaagaattatattattcggattaatacttgtaggaacagtaacttttgcacagtctcccgaagaaaagggcttgaacacgatcaaccgttcttctgccgaagcaacaatcggtttccttgcaagtgatgaattacagggacgtgaagccggattccacggttcgtatgtctcctctgagtatatagcatctatcttacaatggatgggaatccaacctctgaacgaaagctacttccagccttttgatgcttaccgcaaagagcgtcagaagaaaggacgtctggaagttcatccggactctgtagcgaagctgaaacaggaagttcatcaaaaactatctatgaggaacgtactggctatgattcccggtaagaatacgaaggaatatgtcatcgtaggcgctcactttgaccatttggggatagacccggcacttgacggagatcagatttataacggcgcggatgacaatgcttccggtgtctcggctgtattgcagattgcccgggcatttcttgcaagcggacaacaaccggagcgaaatgtaatctttgccttttgggacggagaagaaaagggattgctcggttctaaatattttgtacagacttgcccttttgtttcgcagatcaagggatatctcaactttgatatgataggtcgcaacaataaaccggaacaaccgaaacatgtcgtctatttctatacagctgctcatccctcttttggagactggctgaaaaaggatattaagaagtatggtttacagttggaaccggactatcgtgcctgggacaatccggtagggggcagtgacaatggaacgtttgccaaagcaggtattcctattatctggtatcatacggacggacatcccgattatcaccagccatccgatcatgctgaccggttaaactgggataagatagtggaaatcaccaaggcttcttttcttaatatgtggaagatggccaatgaagcttcatggtaactcagcctcactgaaaggctgttttacatcttgcaataaagggcggaaggaatcagtttgaataaccatgccacatatttccatcttttggagataaaggcgacttttttcctgtctgatatagcctttttgatttgttttacggctttatcgacaggagtaacccaaaacaatccttctcctttcgccatcgctgtatctataaatcccggacggatgtcagtggtgtagacagcaaagggtagctttgccgccttttgccgaagtccctccatgtaattgatttgataggcttttgaagcattataagctggtgctacaccgctgccgcgtgttccgcctactgaggaaatgttaatcagatgcccgcctttctgctgttcaaagtaccggaacccccagccggcgatattggtaaatcccactacgttggtcaataaggtcggttcttcgagctgataggagagctgcggattcagttcccccgttccggcacagataatcagcatatccatgcctcccatttcttgtacaagcgtttccagtgataaaaggggcgtttctgtgtgagtgatgtcacatacctgatagaatagtttatctttatcttgtgcgcaaatctcttttaatagattctcacggcgaccggtgataccgataaggcagtcttcacgggcatactgttctgccaatccacgaccgatgccggaggttgcgcctacaattattattttcttcatgaattaaaatagactatgtttgcctgcaaaggtaggggaggagtctgaataaaatcttgattgaaatcaagaatttacttccgaactacttttctccggatgcggctcaatgtttccggacgaatcaggagataggaggcaagttcttttaaagtaatcagtttcagcaggtcaggacagcggttgataatatccagataacgttcttccggtgtcagactgtacatggagatcatccgatcatatatttcccacagaagagtttccgcaatccggcgtcccagtttttggtggtcgttgttaatgtcgtagaaatctgccagttgggaatggttgatcacatacaccgtacagtcgcataacgcttgaatatctacatttgattggtcctgcaactggaaagccggataattcccgacaaaagaatggtcgaatgtatatccgacaatgctgctttcgcccagactgttgacgcaacaatagcggaaagagccggaaacaacaaatcccatgatcttacaggcttctccttgccgtacaaagtactctccttttttataagaagtctcttttccctgctgtaatgtaaaatctacaataggggaatagttgatatgggaagtatatttattgaaatcttccacagtacgacaatgattaaccttcgtttatcacttggaatccggcaagtttcaaatcctcccaataaccgggatacgatttggaaacaacttgcgggtcagcaatcagcagcttagggaaggtgattactgccggtgcgaatgccatcgccatccggtggtcttcgtaggtcgcaatcacaggaaccgcttccggttcgcaacgttcgccgttccacatcaatacgctgtcattttcttcttcgatgaggtatcccagctttttaagttcggttctcaatgcggcgatgcggtctgtttcctttattttcagactctgcaagcctgtgaaacggaaagggatatttaataaagcgcaagttacaacgaacgtttgtgccaggtccggaatgtcaacgaagtcttcttccagtcgttccggtgtcttgcctgtttttttgatctttacgcctttgggagtgaactccgtcgtgatccccagacgggagaaaacttccgctccccgactgtctccctgataactgttgcggaataatcccaacagttcaatctctgcttccggagacaaagcggcaatctgataccagtaagaagcagcgctccagtcgctttctacggtgaaggggacactctgatacggttgcggagctacggagatgctgctgggtgaagtccatgccgcttttgctccgaagtcctgcattaattgcagtgtcagattgatataaggacgggaaatgatttctcctgtcaagtgcagtgtcagtccgtctttgagcacaggacctatcatcagcagggcggatatatactgtgaactgacgtttcccttcagcgtgatttcatttcctttcagctctgcgcccttgatgcgaagaggcggatatccttcgttatgggtgtactctatttcagctcccaactcgcgaagggcgttgaccagaatctgtatcgggcgttgctgcatacgggcggtgcctgtgataatccgttctcccgaagtggcactcagataagcggtcaggaaacgcatggcggttccggctgccatgatgtctatagtctctttaccttcggtcagggcttttatcatgacttgggtatcatcgcaatcggacaggttttccggcggataaatgcctttacccagcgcattgatgatgagtgcacggttgctgatacttttggaagctggcaactggattgttgcctttaccatggaaggggaaataagtttatagagcatcattctaagtatattctttgttatggagtacaaaagtagagatttattcggagacttccaacagcttctgactcttatcgagagagttgaaataatatctgtaccgatgtttctgctgatacctcatgagccatggaatggcaagaaggatgcccgtaaagagcatcagaatgaatgtaagcccttttaatccttcgtaatcattgaaatattgaatcacgaacctgacggctgttccgtaaaagaatatcagatatatgatgaaatcaatattgattcttcgttccagctgttttttgagcattgctccggattctttcagtgaatatgtgtctgctgaccttgtgaggagctgataatgtccaatggccgaaaccagcagaaacagcagaaaggcacttccggcccatagggagatcgaggcgcttcccatgatgatcgtatcccagatactggcagctacggagaatgccagcaggatggcaaataaagagatcaacgttttctgacgacgtaaggtttgggaaatggtacgacaatgcttcttgcgtatcacttcttttatattcattggctttatttctgtgccggtatgtatttctttccagcattctttcaaattattgtcttccattgtttaattgtttaatgagttgtttcttgattctattaatttttactccgacattactctcggaaatgccgataacggcggcaatctctttgtattcatagctttcaagataaagaatgataatcgctttttctatttcggacaaccggttgatggcttgatatagctgctcttttttatccgttgcggtgttctcttctggatggctgtcatgtatggcatattcctgtgtcgataactctttgtaaacgggctgcacagattctttccgcacaagatcgatggcagtgttcagcgtgactctgtagagccatgtcgaaacggtgctctcctgcttgaatttggggtatgctttccacagccggattaatatctcttgataataatcctcacggaacggatgctggtagaaatagatattgcatattttctgcaatatcccttgatactgattgattagttcgataaattcttcttccacttcatttaaattttaatgtattttggagagttagtcgtatgacgggggattattcttacaaaagaagaaatagaaaatgatatttaattcctgtccggcggataaaaaaagttctttctgcttatcaattaatcatttataatgatttgttagcgaaaagattttatatttgtggcaaataaaataactaatttatgaatataccgaatatccgtttactgaatcagcagttattaaatccacttttccgtgaacctaaagagttggtgtcttggatgggagccatgcaggcacagaactattccatggtgaagtgggcagtagggatgcgtctgaaatcggctacaattcaaacagtagagaaggcgttgcgtgagggagaaattctgaggactcatgtgatgcgtcctacgtggcatctggtggcggcagaggatatccgctggatgctgaaactttccgcgcaacgtattatttcggcaaatgattcttttgcgaaaggatatgatctggacatcccgaatgaactctatacgaaagcgcatgacctgttggagaagattctttgtggaaagaaaagtctgacaaaacaagagattgccgaacactttaaccgttcggggattgtggcggacaatcgccgtatgactcgctttatggcacgtgcggagcaggaaggcatcatttgtagtggcgaggacagaggaagcaaatgcacgtacgcacttttggaagaacgggttccgccgatgcccgaactgacgaaagacgagtctttggcgcgcttggcacggagttatttccgtagccattctccggcagttttgcaggatttcatttggtggtcagggctgtcggtttcggatgcaaaacaggctgtttatctgattgcttcggaactgataaccgaacaatggaaggaacagacatggtatattcatgacatctgccggactcgtggcaaactgtcggggcatatacatcttttgccttcttatgatgaatatctgctgggatataaagaccggacggatgttctgccccttgaacattattccaaagcgtttactaataacggattgttctttccgattgtccttcataacgggcaggtcataggaaactgggataaatcggtgaagaagaaaagtgtggacctgaagtattcatggttcaggcaggtggccgatatgaatgaagaaacgttggaacgggagcggcagaaatttacccgttttttggaaaaatagctctatgggacatcggtaaagtgggagtgtttagtggaaagttccgttaggatacggaactgggttctgttactatccattagccgacgatagttactcattaatcacataaatagcgatttttttttcgttgcacctaggtgagacgaaagagtcacctaggtgcttcagttgtttaaccaaggtgagacaattgttgtacctaggtgcaacggaagaaaatagccaagaatgacgatcattttggctgatggaatacttgtttagccatacatctccctaaagggtaattgttctgagtgaatcgctattgattggctcaacaagactgtccgtgaagtgtgattgtgtaccatcattttgctccgccatctaagggagcttgttggaagaactgtctttctttatttgtcggcttgttttttagcccattccagtctccgctgatctgccaaaggagttaccttaaattcttcgaatgtggccgtgaatccctttccgtccgggcaggctcccattaatccgaccataaccggacaattatcctgcaaccagcaagtacgtatcatcgtatattccttatcatcgcgggagaagaaaatctccactgcatccagtcggcggaccgctttaatccataaagaacgaggagcatccggcagttgcactacactccagtcgctggtgcggtgggtgactacggcacttacattctgtttgccgtctacgtactctacccctgcctttatccagttctcatgatcgatgcgcaacatcaatcccatttggtcgaaagtagtcacatagtttccggtaatctttactttcacttcgaactctccgccataagtagcatagtagaaaggtccgtcgtctaccgtaaatccgtagtgggaaatccgccagaaatcggttttcgccggaacgtccatcactaaagccttgccttcttttatttcccattgctgaggctcattcagccagttcattttgtccaaactttgtgccatagaagaagttgctgccgccaataacgcgattgacatgattttgatttttaaatgtttcatgttcttttcttatttatttatctttgtggtgcaaagataggtcatgcctgtccttgcgacaatactgaataataaccattttatacgatggacgtactacaaaaggaaatagatgaagtctatgctacgcatccgacagcgcacgaagcactggataatggaatagtggaacaacaccagcagtttgtccgctcattgacggaagttaatggagggtgtgctgtcatttccgatctttcgaaccggaaaagttacgttactgtccatccgtgggcgaatttcctgggacttactcccgaagaggcggctttaagcgtaattgattcgatggacgaagattgtatctaccggcgcattcatccggaagatttggtagaaaagcgtttgatggaatacaagtttttccagaagactttttccatgtctcccggcgaacggctgaaatatcggggcagatgcagactgcgtatgatgaatgaaaaaggcgtttatcaatacattgacaaccttgtgcaaatcatgcagaacacccctgccggcaatgtttggctgatcttctgcctttattccttatctgccgaccaacggccggaacaaggcatttatgctacgataacccagatggaacgtggggaagtagaaacattatccctttcggaagagcaccgcaatatcctttcagaacgcgaaaaggaaatactgcgctgcatacggaaagggctgtcgagtaaagaaatagcagcgactctttatatcagtgtgaatacggtcaaccgccaccgacagaatattttggaaaaactttctgtcggcaactcgatagaagcctgtcgggcagcggagctgatgaaattgctgtaatattccttgaatttatccgggatttatccagatagagtatttatccaagtaaagatagcagatcatcgagtcttttcacctgtttcaagcgttcgtgtgcgaacgtttccgttacttcatgcttccacatgacttcaaaaggaatatgtactccgtatccacctaaagataagaccggctgaatatccgatttaaaagaattgccgaccatcaaaagttcggaaggagctatttgcagaatactcaatagccggagatattctttttccgtcttgtcggacatcacctcgatatggtcaaagtaaggagataatcccgaacgttccagcttattctcctggtccagcaaatctccctttgtagctactaccaacttgtattttcccgtttctttcagcgttttcagcgtttccttgactcccggaagtaattcgataggcattttcaacaaggatttccctaaatcgacaatttgccgaataatgtcggctgcaatctttccgttgctgatctgtaatgctgtttcgaccattgaaatggtaaacgccttggcgccatatcccaaaatttgcagattattcatttctgtttggaataaggcggctgagatttctttggaggtgccatacggtttcagcaaatccgtatactgtttttccacttcctgaaaaaaaggttcgttactccacagcgtgtcgtctgcatcaaaagctatgactttaataagttctttcatcggtcttgtcgttaatgggggacgagaatcgttccgttatattttgcggcaaagttactgtattttcatataaatccctatctttgttacccgttttaagtttgaattttaataggagatacaataatgaaaataggagataaggtgcgtttcctcagtgaggtaggcggtggaatcgtaacaggattcaaaggaaaagactttgtactggtggaagatgcggatggttttgatatcccgatgccgatacgtgaatgtgtcgtgattgaggcggatgattacaatataaaacgcaagcctgccgcgacagctccgaagcaggaggaacccgcgaagccggccaaaccggaaatgccggttatacagcgccagccggaagtgcgtggcggtgatacgttgaatgtgtttttggcttatgtgcccgaagatgccaaagcgatgatgactactcctttcgaggcatatttggtgaatgacagcaattactatctgtattatacttatctgagtgcggaaggaaaggcttggaacaaccgttcacatggactggtagagccgaataccaaactgttactggaagaattcaccaaggatgtattgaatgaaatggaacgggtagctgtccagctgatcgctttcaaggatggaaagcctgctgccatcaaacctgctgtcagcgtagagctgaggattgatacggtgaaattctataaactgcatacattcagtgcttccgatttcttcgaagaacctgctctgatttatgatattgtgaaagatgacgtgcctgccaagcaggtatatgtgtcggcggaagagattcagtcagctttgttgcagaaaaagtttgtggataaacccaagtcgcagcctattatgaagcccaaccacggtcagagcggaaaaaatgggattattgaagtagaccttcatattgattctctgcttgatgatacgcacggaatgagtaacagcgaaattctgaactaccaactggacaaattccgtgaagtaatagaggagaataaagagaagcgtgagcagaaagttgtgtttattcacggaaaaggagacggagtgcttcggaaagccattattgatgaattgaaacggaaacacagcaattaccgttatcaggatgcctcttttcaggaatatggtttcggggctaccatggtgactatcaaatgattccggtgtacttgtaaatgatgctgaaaatgtatttgccggaataaagtccggcaggtgggatgagataaaaagaagggtggagaacttgaccggtctccaccctttctcttgctatatgattcaattttacttacttaggtcgatgcctttattcagtaaagtaaggttcatcaaagcggcatatttagcatattgttcagcgctgagcgtctttctcataagtttcaagttgccgtatacagcgttgcgcaattttgcttctttatctttcttggctgtagtggctcttgacatctgttctgagaaataatcgcagatgtttgctacttcttcgctctgaacagagtttaactgcaaatatttacctaatttatttacgttgatgttaccttcccattttgcagttgtaggttggtttcctgctgcaaaagtcgaagcagcgaggcagagtgctgccactaatgttaatcctaaacgtttcataatacctactttttaattgttatacctaaaaactattcctaaaaaacaaatctaatacctattgaaaactgatctaatcgcttagttttttctttttacctatgcaaatatagcgatatgttttatagcataaaaataaagaaaaggaaaagattttgtttcggttgatttcttgatgtaaatcaagaaatcaactgctttttgatacaaaaagaccttattctgaaacatttttgcaatacgtgtgcggaaacgaaaatgtaatataactgaattttaaggaatattgctgttaaaatgatattgagcaaaggaaggtgacgagaaatggaacactgaaatcaactacaaaaccatgaaagatagaaatgattacgaattcttttccggaacatcgggtgatgatgggaagagtagtgtccattgtggtagctcctcctacagaaataggggccagcttgccgaaatacttcacgagtaacggggctcccagcaatgctatgatttcacgcatgatgttggataacaatgcgattgttcccaattccggacctttatattcggtgatgaatatactcgaaagggaatagtagccgaatccggctcccactgccatacagtctgaagaggttctttggctcatgaaaatgcctgctacggcgcatcctgccaatgtccccagtatcgtcatgacggggagaaacatcaggcggggattcagagaacggaaacttttcagtgtgttgggatcattaccgatactgatacctacgcagaacatcagtccgcaaagggcgtaatagcttagtttgctatccgtaaaatcgtaaggaatcagatgataaaacccgcaaagggtaccgagaatgaaaaatgagacgatgatcagacttcctttcatacttccgtctcctttcctttattccttatatataataggtaccagagtccccatgcgcaaagtatactgccggtcactgccgccagtgtgataatgagtgcttcgagtcccaatgtatgcagtcctttgatgatagcctcgtttcctcctacatcaatcccgaggaggaagagcaggacccatatcagcagggtgattattttatgtatccaagatagtcttttattacgtaacaggaagccaaaaagcattcctgtcagtataattccgatgatgataaacatagtaagtgcctgtttttggctgcaaagataattgaaatagatcgttgttcctaattaaagtcggtggagacgttcgtaaaatgaaaggaaactttcagcgaatttggaataaaaacagaaattgaagcctggtttttagtaagatgtctaatttaaattcatatatttatagccgtcaaattaatgtaagatatatgcggagactaaaactatattatttgtttttccacagtacgttgaaaataaacgttccgctgtctatattaggtgcacttattgtatcaaaagctgactggagcttgttttgggaagcttttccttatctattgggtggctggggaattgttgccagtttgctttataaggagtttcttgaaaaggaagcctactttttctattataattccggaattctgaaacggaacttgattgtctttgtgtttgctgtatattggtctgtactttggattgtaaaattatgcatcacttgcttgaaatagatagtattattaagaatttcggtaccaggcaactgctgactgatgtttacctgaaaataaatacaggtgatgttattggattgttcggcaggaacggtacaggaaaatccgtgttgatgcaaataatcttcggaacaatgaaagcagaccggaaatttatccggttggatgaatgtaaggtcctttcggctccttaccaacatgcaaggacaatagccttcctgccgcaacaaggctacttgcccaagcatgaaaagataaataaattggtagactgttacctggatgctaatgtcgttccctatttttatgaggatgatgaagttgcccagtcgtgtatggaacgacgtgtctcccaactttccggaggtgaacggagatatttggaagctaagttgcttttgctgggcaatgctaaatttgtcctgttggatgagcctttcgattatttatcctttcatttggtagataaactgatcgggttaataaaaaaacattcggaagagaaagggatagtgattgctgatcataattacgaaaaagtcttagaggttgtcaatcgacttgtcttgattcgggagggagtattgatggaactaactgataagcggggattggtggagcaggggtatcttttagatgaaagttacttatgaatcctgctcctatatttatttttgcaagtcatttcgggttattttccctgattcgaaccgtttgagatacttccgtgctgatacctatcattcccgtacctccatgtacattactgggatatctgagaggttcgttaattgtttcgtcataaacgtcggaatcgactagattgagtgctttcagatagtaatattctgtttccgtgatactcaacaaacggatgatgacatccattccttcataatatccgttgtaattgttgttgtatgggatggcgggatcgttgtagaccgtcattgtataggaggtatctctaaatcgcgaatcatcaaagacaccataaatgtttttagctgtgtcgaacagtccgttgtcttcgtcatctcctgtggaaggttgaccgtctgtcagtactatgtcttcgcgtccgataaatgaataagtgatatgctttgtccagtgaaggtaatcttctcctccttcttcgtggttgtatccccatagtcgcatttgtttatctactacaatgcggtagaagtttgcctcgttcgggcggtctttaaaagttattttgtagcgcatgtagtcttgagtatgtccgttttgtattagcgggacggtgagcgtgtcgatgttttctattttatcaaggcgttgcggaacggtgacttctgcccaggcatgatatttgccgtcatcggtcatggcatcaatacgcactacttctcccgaagcaaatttgcctgtgatgttgaaccggcattgcttgtcatactcagtttccatcgggagtgggcgcaaggtctctcttaactctccgttgacgtgaacctctacagtggcattttcaatgtggttggcatagtcttttcccgtcaggttaaggaataagacatttgtcagactgtcagcgttaatgaatgcattcattaccaatttaggaggattatcctttatattaaaagggagttcattttcacaagatactgtcaccagtattataactagcaggataagcggatgatatatataagttttcatgttaacttagaatttgtaagtgtaagtaaaagatggaatgcaggggagcagggtatattttttgatcacactttttccatcgtcattatgagagcgaaatacccatgccggattcatggagttgtatgcattataaagactgatgttccagatacgcattccgtgcttggtctttttattgaaattaatccctatgttcaaccggtggctcgcaggcagccggtaattattgcgatgttctatgtaattggcctctccaacattaggggaattgttataaataggattgtagtagttatcgaatcccagaataaagccattgtttgctccattaccaggacggatgatggttgttttttcttcgggaatagtactggttcctcctgtgtaaaacacccacgaggcaccgatgtcaatacgttcgctgaatttatggttgagagtcagattaataatatggcgccgatcatatttgtatggaaatcgctctccattgttgatagcacctttagcaaatttgcggtcgcttttggataaggtataagacaaccagcctgttgtcttcccgagcgttttttgagccataaattcaattcccatcgaacgtcctttccccatttcaactttgctttcccatccggtggaagaaccgaaaaaactgactccgtctttatattccagcacattgtacatgtctttgtaatagccttctactgagaactcccaacctttgatacctgtataatatccccccaatgaatactggtgggatcgcatcggtttgattttttttgtgacaggcacccataaatcagtaggcatagcgatgggcatggacgaaagcagatgtacatattgactcatctttgtataagatgccttgagaattacgtctttacttagttgataacgtgttgagacacgcggctgcaaggagaaataactttgtttttgtacttgaaacagagaaaagtgtaatccaagattaagccgtagacgagtaccgatttttaggttatcttctgcataagccgatacttcatgtgcataaatccggctgttgttcatgctgtggtaagtagtgtcgcgaaatgcctcagagtctaccttgtctgatattttggaggtcatcacttccggacgaaaacggtgatagatatatcctgctccaaatttaatatggtgcataggagatgggttgtaatcaaaatctatctgataattccagtcattgatacctgaacgatagtctgaagagtatcggttgatgaaggttgtgttattggtgagtgaatattgattattcgaatatgcacttacattgaataggtagttgttgtaggaaactgtcgtgttgctaaacaggcgattattgaaaatgtagttccatctggcggaaatgattgtgtttccccagttcattttacttccgtccttgaaatcgctattatcatcatattgggtagcgaagtgatctttcccgttataagcactcagatataaacggctccggtcggaaaacttgtgattgatctttgcattgatatcataaaagtaatagttgtatttctcatcatcgggcatgaatggtttggctattaaatcaatatacgaacgtctggcggatatgttgaatgatgttttgtctttcacaatcggtccttccaaatttattttgctggttagcaagccgatactgagtgtcccatgatattttttcatatccccgtcattggtgcgtacgtcaatgacggaagaaaggcgtccgccgaagcgtgcaggaaaggaacttttaaataaagtgacctttttgatagcttcaggagtaaagacggaaaagaagccgaacatatggtctacgttatataccggagttccgtcaagtaagatcagattttggtcgggactgccaccacgtatatataatccagccgatccgtctactcctgcctgtactccgggcattaactgaatggctttcattacatctgattctcctaatatacttggagtattcttgatttgcaccattggaatctcgacagctcccatctgtgtggcaactgtccctgcttctgctttatctgaaacgaccactacttcttctaattgtgcgtttcctttcatacgaatattcagcagagtatcttgagcaagggtgaaatgatgtgtttctgtggtatatcccaaataagagaaacgtaattccgtttctccttcgggcagagtgatactataaaagccgtaaggattggtagtagtgccttgatattgatgactctcaatgatattagtaccaatcaacgtctcggacgacgtcccgtcggtaacatatccgctgatagtaaacttgcggcttaccggcttttgcacccttttcttttgcaggagaatgtatctctcagagaacttgtaactgatcggttcatccttgaatacgagatccagtatctcatgcaaaggcatatctttcactttcagattgattttatggctgatgctgatttcttcactgtagataaaagaatatcctgtagagttttcgattaacttgacgaactccttcaatgtagcatttcgcaatgtgattgtgagtcgggcatttgcattctgtgcgtatgcctgtgcggtgataaggatcaccatacctatcagaacgagcgttctgataggtaggtgtccttggtgaatagttctcatttagtctagtttttagtaatagtaatctgttgagtgtttcgtgaatagttgaaataaccggcattatgcagtacagataaaatcgcatccaagtcttctccattacggaatcgcgctgtgatccgataatttcgcaaggttgagtcggcaatgtgaatggttgttccgaacgagttggaaagttcgcgggcaatctcctgcaacggcagatcatcgaatatgaactccccgtggcgccatgaaatttcatctccggcattctccagtaccttgcgagtaagcttttgttccaccttattatatatagccgcctcattcggtttcagcaccatgcgtactgagttgtttttattgctgactgcaaccgaccctgttaataaagtcgtctttacatccggattatcgggataggcgtccacattgaagtgagtgcccaatacttgaacgtcaatcgtttctgtctgcactataaacggatgctttgggtctttacttacttcaaaataggcttctccgctcaactccacttcccggttatccgatttgaaccgttccggataggaaagggaagaataatggtttagcgtgacggaagtgccgtcgggcagatggacggtacgtgtttctgccaaagtgctaacagtctgtatggttgccggctgcatgtacagataagctgtccataccgatagacagagtaaaactactgctgccgctgccgcaaatgtgcgtgtcagatacaaccggcggttgcggaaattcagctttttctccagttgcggataactggatgctgctgaaaaacgtcctctcggtgagcgggtggaagcgatgagcttgttcagtatgtcttctaattctctatcggtatatttcatatctttttctatttagctttctttctaattccgtttcagcagaatcgtcagcttgcttacactgccttctttccactggggagtacaggataaggtaatgttctgctgtttcagtaccatctttttgggatataacttaatggtggtcgttgccgatttctgtcccgccttgatggtgactttggtttctgttagtttcataatcggtgcctgtcccgccggcaaagcaggagtggcaagtaacactgtcctgtcttctttggatttgtcggtggcaataattttaatctgcaactcactctcggattgattcttgtcacattctactgttcgggtagatttttcaaatcctacataatccttaggataattgtcattgtcgttgttgcaggaaaataggctcaggcatgctgttaaaaggacaaagagtccaacgtttgcgtcattaaactttttcatcattcaatcttttttagtgattaatcggtttatttgctgataaagaccggagattgacagaaactccctacgccttttgtgcaaataaaagttaatataaaaaagaagtgctgaacggttcgggtgatctccggttatccgctggacgaaatcatctctttcagtcgggagacagctttctgtagctgggcatcaactgtctttatgctgatatccaattcttctgctacttgggcataactttgtttttcttcacggatacggatgaatatttcccggcaacgttccggaagccggtcgagtgctttcacatagattgcaaacagttcttcactgattaatgactcttccggagaataactttgttcctgtggctccggcagggaatcggaatggatggtggcgtacttcgactctttttccagataattgagagaagcgttcttgaccagaataaagcaatagtcctcgatgtttttcacatcaagaagggtgtcgcgctgcttccagagtttgaggaagatgtcgagtacgatttcctgcgaccattcttcctgtttcacataatagtaggctatgcggaagagtcggtcgtaagtcatgttatagaagtcgcggaaggctgtttgcgagtccagttccttcatttgccgtaataacttccttacttctgattcggtcatcggctgatcgtttagttttttaatttacccaaagcaagtcgctcataatgctgtcggagatgaaaattccttcccgtgtcaggcgtaaagccccctcgtgcacttccagtttcccattttccagatagggggcagacattttccggcaatattcccacagttcattaccgaactcttgttttagtttttctataggtgttccccatacggtgcgtatggtggtaatgataaattcgttgtaacgggtcgtttggtttagattttctgtctcaaagtcgcgttggtttctttctataccttttatatataggtcgatggaagatacgttccattcgcgtgttgctccattgaatgaatgtgcggacggtccgcagcccaaatatggtattcccctccagtacgaagtattgtgacgggagtatttgtcggggcggcagaaattggatatttcataatgctcgtatcctgcattctgcaaatgttcgatcagcaatgtaaagaactgcagactggaatcttcgtctacttcctctatctgatgctgcttcaacatattatatataggtgtatcttcttcgtaagtcaaatggtaagcagaaatatgctctacatccaggcggatagcttgccggaggtcgttttcccaccgtccctttgtttcgcccggcagtccgtaaatcagatcaatgctgatattctgaaatcccgcttctctgcacctgcgaacagcttcgatggctgtttgggaattatggcgacgtttcagtaatcgtagtgtcgtatcatcaaaagtctgtatccccatgctgatacggttgaaagggagcgaggataacatcttcagatattcctgtgacagatcgtccggattggcttccagagtaatctcccggcagtgttccattccgtaattttcccgtatagtttcaaagatgcgtttaaaatcagcttcctccagttgagagggagttcctcctccgaaataaatggtttctataggttcgcctttcagatattctttccgcattcccagttcatggcagagggcgtgcacataacgcgtctttaattcgctgcgggtagtcgaataaaaatcgcaatagatgcaacgtgtcttacaaaaggggatatgaagataaatacctgccatagtagatgtttagtttgttaccaattgattatagcctgcaaatttaaaccttttttctgagctattgatacaattaacgggaattaggtataagtttggcctgcctggtaaccataaaacggaccttatgttacataacattgtttagtaacactgtcataaatattgcttttcccccaataaatccctaatttgcgcaacactaaattaatggtatgcgagaaacatactgagtaattactaaaatcttatatattatgaaagtatatcagactaatgaaattaagaacattgccttgttgggaagttctggctctgggaaaaccactctcgtggaagcgatgcttttcgagagtggtgttataaaacgtcgcggatctgttgccgcaaaaaacacagttagcgattatttccctgttgaacaagagtatggttactccgttttctctaccgttctccacgtagaatggaacaataaaaagcttaatattatagactgtccgggttcggacgacttcgttggcagtacggtaactgcacttaatgtgaccgacacagcaattattcttctcaatggccaatacggcgtcgaagtcggtacacaaaatcacttccgatacactgaaaaattgaataagccagttatttttctagtcaaccagcttgataatgaaaaatgcgactatgataatatcctcgaacaattgaaagaagcgtatggatctaaggtggttcccatccaatatcctattgctaccggtccgggctttaatgccttgattgacgtattgttgatgaaaaaatattcgtggagacccgaaggcggtgctcctacgattgaagatataccggcagaagaaatggataaggctatggaaatgcataaagcattggtagaagccgctgccgaaaatgacgaaggactgatggagaaattcttcgaacaagattctctgacagaagatgaaatgcgtgaaggtatccgtaagggtttgatcgccagaggtatgttccctgtattctgtgtttgcggtggtaaggacatgggcgttcgccgtctgatggaattccttggcaatgtagttccttttgtgtctgaaatgccgaaagtggaaaacacagatggtaaggaagtggctccggacgtaaacggtcccgaatctttgtacttcttcaagacgagtgtcgagccgcatatcggtgaagtatcttactttaaagtaatgagcggcaaggttcgtgaaggtgatgacttgctgaatgccgaccgtggttcgaaagaacgtatcgctcagatttatgtcgtagccggtggtaaccgtgtgaaagtggaagaacttcaggcgggtgatattggtgctgccgtaaaactgaaagatgtgaagacaggcaatacactcaacggtaaagactgcgattataaattcaactttatcaaatatccgaattctaaatattcccgtgctatcaaaccggtgaacgaagcggacgtggaaaagatgatgaccatcttgaatcgtatgcgtgaagaagatccgacatgggtgatcgagcaatcgaaagagttgaagcaaacactggtacacggacagggagaattccatttgcgtacgttgaagtggcgtctggaaaataatgaaaaacttcaggttaaatttgaggaaccgaagattccgtatcgtgaaacgattacgaaggctgcccgtgccgactatcgtcataagaaacaatccggtggtgctggtcagtttggtgaagttcacctgatcgttgagccttataaagaaggtatgcctgtgcccgatacttacaagtttaatggacaggaatttaagattaccgtgagaggcactgaagaaattccattggaatggggcggtaagctggtatttattaacagtatcgtaggtggctctatcgatgcccgtttcttgcctgctattatgaaaggtatcatgtcacgcctggaacaaggcccgttgacaggttcgtatgcccgtgacgtacgtgtaatcgtatatgacggtaagatgcacccggtagactcaaatgaaatctcctttatgcttgccggacgtaacgcattcagtgaagccttcaagaatgccggtccgaagattttggaaccgatttatgatgtggaagtatttgttccgtccgacagaatgggtgatgtgatgggagatcttcaagggcgccgtgccatgattatgggtatgagcagcgaaaaaggtttcgagaaacttgttgctaaagtacctttgaaggaaatgtcttcatattcgacagcgcttagttcacttaccggcggacgtgcttcatttatcatgaagtttgctagttatgaacttgttccgacagatgttcaggataagttgattaaggattttgaagctaaacaaacagaggaataaacaataattctctcaaaactgttaaaaccgttgtcttttttaagtaaaaggcagcggtttttgtttaactatgattaataaagatggaaaatcgcaaggaaaagatttaattttttattaaatttgcaaaccaaaggaggagttatattgttgtagtaatcagaatacaacctaaatagctctttacggttaatttccgggaacttccggttaaatcaagttaatgtgttaggagtgttaattagggagtgttaattttgttgctatgaagaagtcaacaatttggatattaagtattgtaatggggctttctttccttagtctgttgtatttgcaggtcagttatatagaggaaatgatgaaaacccggaaggagcaatttgattcggctgtgcgcaacagtttggatcaggtttccaaggatgtagaatatgcagaaactatgcgctggttggttgaggatatttcggatgctgaaagaaaagcgctgactgaaaacaatacttcattagggcagaataatgtagttcgggggacacagcgatttcaagtgaagtcacgggatggcaagattatttctgactttgaattgagggtgatgaagatcaaaccgtctgaacttcctaaagcgatggtacgtggacgaaacacgattcctcagacttctaattcgatgttggaagctatcaagaatcgctatatgtatcagcgggcactgttggatgaagtagtgttggacatgattagacgtgcgagtgacaagtcgattggtgatagagtacggttcagggaccttgacgattatctgaaatcgaacttatataataatggtatagacttgccttatcattttgcagtgattgacaaggatggacgtgaagtataccgttgtgcagattatgaagcaaaaggaagtgaagaatcctatcagcaggcattgtttaaaaacgacccgcctgcaaagatgagtattctgaaagtgcatttcccgggaaagaaggattatatttttgattcgatcagtttcatgattccgtcactgatatttacgttggtgttgttggtgacattcatctttacgatttatatcgtattccgccagaagaagttgacggagatgaagaatgactttgtcaataacatgacgcatgagttcaagacgccgatatcgactatctcgctggcagcgcagatgttgaaggaccccgcggtagcaaaatcaccgcaaatgttccagcatatatcgggagtcataaatgatgagaccaagcgcttgcgctttcaagtggaaaaggtactgcagatgtcaatgttcgaccggcagaaggcaacactgaagatgaaggaaattgatgcaaatgaactgatttcgggagtgatcaatacctttgcactgaaagtagaacgatataatggtaagataacatcgaaccttgaggcagccgatcctgttatatttgcagatgaaatgcatcttaccaatgtgatcttcaatctgatggataatgcggtgaagtataagaaagcggaagaagatctggaactgaaagtgaaaacgtggaatgaatcgggaaaactgatgatttcgatacaggataacggtatcggtatcaaaaaggaaaacctgaaaaagatatttgaaaagttctatcgtgtgcatacgggtaatctgcacgatgtgaagggctttggactggggctggcttatgtgaagaaaattattaccgatcataaggggaccattagagcagaaagcgacctgaacgtaggaactaaatttattattgcattacctttattaaaaaataattgatatggacgagaaactgcgtattttattatgcgaggatgacgaaaatcttggcatgcttttaagagaatatttacaggcaaaaggttattctgctgagttatatcctgatggagaagccggttataaggctttcttgaagaataaatatgacttgtgcgtgtttgacgttatgatgcctaaaaaggatggctttacgttggcacaggatgtccgtgctgcgaatgctgagatacctatcatcttcctgactgcaaaaacgctgaaagaagatatcctggaaggatttaagattggtgcggatgattatatcacgaaaccattcagtatggaagagttgactttcagaattgaagctatcttgagacgtgttcgtggaaagaagaacaaagaaagcaatatctacaagatcggtaagtttactttcgatactcagaaacaaattctggctacagaaggcaagcagacgaagctgactaccaaagaatctgaacttctcggactgctttgtgcacacgctaatgaaattctgcaacgtgactttgctctgaagactatctggattgatgataactacttcaatgcccgtagtatggatgtgtatattacgaagttgcgtaagcacctgaaagaagatgactctatcgagattatcaatattcacggaaaaggctataagctgatcacaccggaagttgaatcttaatgagtactccgataaccaaaaataaaaaatcccggaaacattcgttcccgggattttttattgatttctaataaattaatcagcgatcttcttattaatgacaatataagaaatgagtcccagtactacgaggaatactgaactgcccaaaaccgcgttgttgtttacattgccggtaaaggaacaagccaacaggatgaccactccgatcaagattaatatcaatcccaaattctttaataagcctttcatgcgtgtgtattttaatagattataatattccagtcacaaattaaagcataattctttaacgggcgaaataatttaggtgaaaaatccattataaagacagatttagtggattttatgaattaaacgattgtttttctgtttagtctttggtattgtagaataccttttttaaaacctcttgcccgatgctcagttcttcgagagtgatgccatgcagagcttccttcagtgtctgccccgcaatgatgcgtgctttctcttccagttcttttccgtcttttgtcaggtggatcagattggtgcggcgatcttttttgtcggaaatacgtactacaagatgctgccgttccatgttatctatgaggcgggtcatactgggtttgtctttaaaagttgcattgcacaactcttgttgtgtaacgccgtctttttcccatagaaaaatgagaactgtccattgttctgggctgatttccagaccgttctgacggaaattacgatacagtttccgattgattgcagcggaaaccttaccatttaggatggcgaatataagccggatatcgaaattaaattgctctatcatgaaattattgtttaaacaactttgcaaaggtaagccacttcccggataattcctatattaggatacaaaaaaagattaaatatttgtagttcaaaataaaatgcctaactttgcacccacattttaaaataaaataaattatttatttaattaaacgagtatgaatcaatacgaaaccgttttcattttaactcccgttttgtctgatgttcagatgaaggaagcggtagaaaaattcaaaggtattcttcaagctgaaggtgctgagattatcaatgaagaaaactggggactgaagaaattggcttatccaattcagaagaagtctacaggtttttatcaattggttgagttcaatgcagatcctactgtcattgacaagttggaacttaacttccgtcgtgacgaacgcgttatccgcttcttgactttcaaaatggacaagtatgctgcggaatatgctgctaaaagaagaagtgttaaatcaaacaaaaaggaggattaatcatggcacaacagactcaatcagaaatcagatatttaactccgccctcagtagacgttaagaagaaaaaatactgtcgtttcaaaaagagcggtatccgttatatcgactacaaagatcctgaattcttgaagaaattcttgaacgaacaaggaaaaattcttccacgtcgtatcactggtacttctttgaagttccaacgtcgtatcgcacaggctgtgaagagagctcgtcacttggcattgttgccttatgtaactgacatgatgaaataagaaggaggaaaagtatggaaattatattgaaagaagacatcgtaaacttgggttataagaacgatatcgtaaacgtgaaatccggatacggtcgtaattatctgatcccgactggaaaagctatcatcgcttctccttctgcaaagaaaatgttggctgaagacttgaaacaacgtgctcacaaacttgagaaaatcaagaaggatgctgaagcattggctgctaagttggaaggcgtttctttgactattgcaacaaaagttagttcaacaggtactatcttcggttctgtaagcaatatccagattgctgaagcattggcaaaactgggtcacgaaattgacagaaagatcatcgttgtaaaagacgcagtgaaagaagttggtaactacaaagctatcgttaaacttcacaaggaagtttctgtagaaattcctttcgaagtagttgctgaataagagcaaatttacttcatatattaaaaaagcgatttgttctgatggataaatcgcttttttttatcatctttgctagtaatatgaaattcaaccgttgttatctgaagagaatcgttttgctgttcctggttgctctgggaatcggcaatgctctttatgcaaataacgaattgaaaatactggctgactctctgcataaaatgatagatgcgaagcctctcttcgtccagaagaaagagcagcgaatcgcccggattaaatgtttactgaaggactctgggctgactcccgatcgggaatataaggtgaatctccaattatacaatgagtataagaaatttaatatagactctgccattcattatgtcgaccggaaccttgaaatcgctcgtcagttaaatagaaactatttgaaataccagtcttctttgcaactcagccttgtatattccatgtgcggcagatatagagatgcagaattacttctcgaaaaaatgaagccatcagaacttcctcgttcattattagctacttattatgatacatatgcccgtttttgggagtattattcgatttctgctaccaataatcagtacggaaaaaaacgggaagtttatcaggattcactgtatgctcttatggatcatacttcctttgactataaattgtcacgggcttattcttatgcaggacgcgattcaacaaaggcgatcaagattttggatgagttgctgaatgctgaggagataggaactcctaattatgcgatgattactcattcgtatgccatgttgagccgctatttgaaaagagaggatgatgcgaagaaatatcttatgatgtccgccattgctgatattcagaatgccacacgtgaaacggcctccttgcaggcacttgcactgatacaatatgaggaaaataatttagcggatgctttcaaatttactcagtcggctattgatgatgtagtttcctccggcattcatttccgggcaatggaaatctataaattctattctatcattaatacggcttatcagacggaagaagctaggtctaaatcgaatctgattacttttcttatctcaaccagcgtttctctttttcttttaatcgtgttggttgtgtttatttatattcagatgaaaaaaacgttgcggatgaaacgggcgctggcacaaagtaacgaggagcttctgagattgaacgacaaactgaacagcatgaatagtgagttgaatgataagaatgatgaactgtgcgagattaataatataaaggagcattatatcgctcagtttttcgacgtgtgcttcagctatattcataaaatggagaagtatcagaatatgctgtataaaatagccattaataagtgctatgaggaactgattaaaaagctgaaatcttccgcattgattgatgatgaacttgatgctctgtatactcgcttcgatagagtctttttgaatttatatccgacttttgtttcagatttcaatgctttactgaaagatgacgagaagatcattcttaagcaggacgctttgttgaacagggaacttcgtatctatgcattgttacgtttgggtattacggatagcgggaagattgccaacttccttcgttgctctacaagtactgtttataattatcgtactaaaatgcgtaacaaggctgcagtggaccgggatgaatttgaaaatgaaattatgaaaatctgaccaatataaacgaatttgtgccatccaataaataaaatgctttccaaacaatctacattttttatattcctaaatgattgtaagttgttgatttgtaaggtttaatattattttataatctacataaagttgtgtagactaaataaagcgttatttatttggctagttttgcgatatcagttttcgaacaatctgcctacagatgaaaattgataccttttatgttgtttgtacttaaattcgcaattttttatggatgcacaattttcacttgacacaaaaataaaagtaggaataatcggtttcggtagaatgggaagattctattgggaggcgatgcggaaaagcgggcgatgggagattgcctatatttgcgatacagatcctaccacgcgcgaacttgctaaaaaaatatctcctgaatctcgtgtagtagagaatgaccaaaaaatctttgaagacgagagtgtacaggttgtcgggctcttcacattggcagactcaaggctcgaacaaatagaaaaggctattcggtacggaaaacatatcatcgcagaaaaacccgttgcagatacgatggaaaaggagtggaaggtggtggatatgatagaaaactccaatgtactttctacggtgaacttatatctgcgaaattcttggtatcataatctgatgaaggaatatattcagaagggagaaataggtgagttggccattattcgtatttgccacatgactccgggactggcaccgggtgaaggacacgaatatgaaggtcctgctttccatgattgtggaatgcattatgttgacatcgttcgctggtatgccgaaagtgaatatagaacatggaatgcacaaggcgtgaacatgtggaattataaagatccctggtgggtacaatgtcacggaacttttcaaaatggcgtagtctttgatataacccagggttttgtctatggacaattatcgaaagatcagacgcacaattcttatgtagatattataggtacggaaggtatcgtgcgtatgacgcatgatttcaaaacagctgtcgtcgatttacacggagtacatcagacacttcgtgtggaaaaaccttttggtggtaagaatattgacgtgctgtgcgatttgttcgccgattccatattgaccggtaagcgaaaccctcgtttgcctttaatgtatgactcgactattgcatccgaatatgcgtggaagttcctgcaggatgctcgtatgaatgacttgccggctattggcaatttacagactcttgaacaaatacgcgaacgcagaaaaaacatgaaaaatggatatgggttgctgcatagtaatccaccacaaataactaactccttaaaataataaaaccatgtcagacttttcaagaagaaaatttcttaaaacgggagccgctgctttagcaggaatcaccattgctcccagttctattttaggtatgagccacgggcacgtttcaccaaccgacaaactgaacctcgcagccgtaggtatcggcggtatgggccatgccaacatcaacaacgtgaagggcaccgaaaacatcgtagccctttgtgacgtagactggaaatatgccaaaggcgtattcgatgaattcccgaatgcgaagaaatactgggattatcgcaagatgtacgatgaaatgggcaaatccattgacggcgtaatcattgctaccgccgaccatactcatgccatcatcacggcagacgccatgacaatgggcaagcacgtatactgccagaaaccgttgactcactccgtttacgaatcccgtttgctgaccaagctggccgcctctaccggagtagttactcaaatgggtaatcagggagcatcgggcgaaggtaccgacctggtttgcgaatggatatggaatggagaaatcggtgaagtaaccaaagtggaatgcgccaccgaccgtcctatctggccgcaaggactgaatgcccccgaaaaggcggaccgcatccccaacacattgaactgggatcttttcaccggacctgccaaactgaacccgtacaacaacgtttatcatccctggaactggcgcggatggtgggattacggtacaggtgcactgggcgatatggcctgccatattctgcatcagccgttcagagctctgaaactgggttatcctaccaaggtggaaggttcttctacattattactgagtgcctgcgctcctcaggcccagcacgtgaagatgattttccccgcccgcgacaatatgccgaaagttgccttgccggaagttgaggtacactggtatgacggcggtatgatgccggaacgtccgaaaggtttcccggaaggaaaacaactgatgggccccggtggtggtctgactattttccaccctttaggtcgaatttgaatggttaaaaatttgataatcagcattgatgctggtgtgttacttcttaggtaacggaaaagtacacttcataataaatcgggaggaaaaagtcgaaaagtaccgtctaatgagggttgagagcatcttggctttagagaaagtagagattcttaggaaaattgggcatataaattcctaagcatgaaaataggcctttttcatgttcagatacattttttttcaaattcagggttaaatcgaaaaaaaagtaggtttttatttgtttaatacatgtgtttttgtctatctttgcgtcaaatttaaatccgttacctaagaagtaacacaccagcatcaatgctgattatcaaatttttaaccattcaaattcgacctaaagggcaagtcttcacgtaatgcaaattcttacgatttacctctgtacgctctttcaactcaaaccccttcagataaatttgtgtcgtctttatagacttatgccctaaagattcactgatcatttcaattggaactccacggaacttggcagtagttgcccaagaatggcgaatcgtgtaagaagttaccggagaggtcaggtgcaaagccctcgccaaacttttcaaatgattattaaaccggcgaagtgcagactgatattcacgataagcacgttcatccttacgtttcttatcaccggaaaggatactgaaaaggtaatcggggcaacccggacgcgatgactgggaattgcgaagctgattcatcatttccttagctgtatccaaaacttccacactcattggagttctggttttaattcgattatatcggagcacattacaatctaaagccgacttttccaaatgagccaaatcggcaaaagacatcccacagaattgaaacatcaaagcagcaatcgattgtgtgcgccgcaaacaatccgtcttgggatcttcgtaaagaagccgtcggagttcactcaccggaagagcccttttctgacggatatccactcctgtatacacatcacggaacagaccatgtacatagggcgcactacccaactctaccccacggttatagatactgcgaagcatacgcatatacgttgataccgtattcggttttaagcccgaatcatacagatgttccccgtaacgacgcaatcggtcacgagtgacttgcctgaaagatacactggcattaccacaaaatttattaaaagagaaaagagcattttgatagacatgtgccgtagaaaaacgaccttcttttcgtaaaaggccgatgtatagttccccacatcggctaaatccatttttattcattatttgcatcactagttattttatatacaattatagggcgaaaatttggaatttccatcttaatgccatttattaattttatttaaatcaaaagaaatgacaacgacaaaaaaatgcctgaaaaatgcaactggcacacaaaagaagagaagtcttgaaactgattatcaggatgatgacgaaattattgacatcgatgaggttagaaaaagaaatggcatcacaggcgaaaaaaaacactatttcattgcctgtcttcgcacttattacgaagatgacgagtttaattcctacgtaaaatctttaacaggactagccaagtacattgcagactggagaatcttttacgtaaacacacatcatggatatagattaatgaaattcaggagtatactcagcgaaattagcagtttaagcaaaggaatcggaataatttcgaagcacgaaaaagaagagaaagaacaatacaaatcaaagtatcacagtagaaaatagcaagaataattggagcgaaaaaatacaacttatacttttgcccccgttttttagataaagaaatgaacgaactatcccgcagaaattatagtgtcactataacagcaagatagtgtcactatcccgacaggatagtgtaactatcatcgcacgatagtgtaagcatcctacagacagttccgccttttctttaaatataactattttactaacaaatttataatgtaatgacaaaagaaaaacggctgatagccactaacaaaacagaagaagaaagagatcgattaacagaagtatggaaaaaacgtatcgtatcagagaaaggttattcggaaacgatcgcagaacgaatagccgaaaaagtgaaatcactggcagactacatgcaatatggccatgccatcatcgcatactacagacagaacggtagttttcagttagttacaggcactcttatttcttattccaaagactttcaccactcttatgacatgaagcaggtacacagtaccttcatattctggtgcatggaagagaaaggatggagaacctttcagattgagaattttctcgattggaaaccaattgtataaacttaaaaacaaacaataagactgatatgagcacaacttatttaagcgtagactattttccgcttaccgtaaactttttcgacagagatgccattgaactggctgaagccaaatatggtatcagagtggatggagctgtatgcaaacttctatgtaaaatattcaaagaaggatattacatcccatggggtgaggaacaatcgttgatttttgcccgcaaactgggaggagaactgaaaggaaaagagatagacggaatcattcaaattttgcttgacaaaggattctttgacaaagaaagctatgagaagtttcagatattgacttcccttgaaattcagcacatctggatagatgctacctgccgcaggaaaagaaagttagaagatttgccctacctgttagtcaatgacacccaaaaacaggaaaaggaaaataatacaaaggatgcaaacaattcgtcagtacaaggtgaattgaaactggaaaatgagaacatttcacccgaaattgctgacatttccggacaaagtaaaggagagaaaagaaaagcagaagaggaagaagacaatacggcttcgccttcgctcgaaatccccggttatgcctacaacaagagtacgcacaacgtcaaaggacttctggacagcctggcacaacatggagtaacaaacaagaaagaaattacagctattctcaagctgtcggattacggaaagaaggggacgcagatatggatcacgctgtctaccaccaagtggggaaagattgataatccgggaaggtatatcatttcaacgttgaggacatagagataaaataaggcacggattacacgaattaacacggtttttagttactcaattcctgaaaccgtgaaatctgtgtaatccgtgcctaaaaaaaattaccacttatagttaataccgaagctcagcaattccttcagctggaaaaagctgccattttcaacggttggttttgaactgtcgtcaaaacgggcgtgtacgtaaagtttagtagaaagatagcggttcaaaacaaagttgaatgtattctcccactccacacgcacccattcgtaattggtcagatagttcagacgggattccagcgaaacagccgaaatgattttccagttgaacgttgactgcaactgagaaccgaagtcgtttttagagcatttgcctttctccagaccgaacttggtttcatctacttccgaattgtcgatatatcgcaagttataagtcagcggaccgatgaaaacagaaagattgaatttctgcttattcaatttgtagtccataccgatactgactgccaaatccgccggagacaggaatgcggaaacaagttcttcgctattggctttgtaaccgtggcagaactgagtcttaaactcggaagaaatagtatagtaccagttctttaacgctcttaatcctaacttattgtacagacggaactggtcggtattaatcaggtaatcatggaatttatccgacggtgtggatgtcatacccagtttagcctccaactgattttcgaaaaggactttctcattatcattgtagttggcataaagctgcaaggtagccagaccagcaaagttactttctcctcccttgtaccagttctcagaaaggtggttctggctgatttgcaaagaaccgttacctccggtaacccaccagttaggacggctgattttcatttttgccttgcctacatcgttgctcatttcttccggctggaaaagatggacaacagatgccttcggagaaatcttcggtttcacatccctacggaagacatcacggctcatgatacggttttccgtggtgacaaccaattccggatgattgagataaagagccatcagtgctttattgaccgattgattggcacgctcggacttcgtatatgccaaagtatcataaggaagaagttccgctgtcaactttttcaagttgtcgggcaaagagtcaaactgtaccggtttccaatccacctttgaatactgcgccatcggagcataataataggctaacggagtaaacagacgaaaatagtcaggatcggacggaatataacgttccggtacagacgggtcattcaggtagtccaactgaccgatatacttattatataagattgatacagtgtccaatttaggagtttctccggacagattcaatttaagcattaaatacttctgaagttctgacgaaagcgtgtctgccttcacaattttcgcttttgccactacggtagaaggttgagtggcggtctgtgctgaaagcgataaagataaagtcgaggtaaaaactacgaatgataataactctcttctcataatattcctaatttggtgcaaatctacattattttgtttagaaaacataggaatctttcaaaattgcattttttaataaaattgtagaggggaaagtctgcattcttccccttttttttataattttgcgctttttaagttcgtaagaaactactaagtaaaaataattaaaacagttatagctgtgggagaaacaaagtatattttcgtcaccggtggtgttgcctcttctttaggaaaagggatcatctcatcctccatcggtaaattgctgcaagcaagaggttacaatgtaaccatccagaagtttgacccgtatatcaacatcgacccgggaacattaaatccttatgagcatggagaatgctatgtgaccgtagacggccatgaagccgatcttgacctgggacactacgaacgtttcctgggtattcagactacaaaggctaacaacatcactacgggacgtatctacaaaagtgttattgacaaagaacgtcgcggagactatctgggtaaaacgatccaggtgattcctcatatcacggatgaaatcaaacggaacgtaaaattgctcggtaacaaatacaagttcgattttgtaattaccgaaatcggtggtacggtaggtgatatcgaatcactcccctacctcgaaagtatccgccagttgaaatgggagttgggtaagaacgctctttgcgtacacctgacatatgtgccttatcttgccgctgccggagagctgaaaaccaaaccgacacagcattctgtcaaggaactccagagcgtaggtattcagccggacgtattggtgctccgtgccgaacacccgctgagcgacggactccgcaaaaaagtagctcaattctgtaatgtggatgacaaggctgtcgtgcagtctatcgacgcagaaacaatttatgaagtacctctcctgatgcaggcacagggactggacagcacaatccttgaaaagatggggctgcccgtaggagaaactccgggactaggtccatggcgtaaattcctggaacgccgccatgctgctgaaacgaaagaacccatcaacatcgcattggtaggtaaatatgacttgcaggatgcttacaagtcaatccgtgaagcattgtcacaggcaggtacttacaacgaccgcaaagtggaggttcactttgtgaacagcgaaaaactgacagatgagaacgtagccgaagccttgaaaggcatggcaggcgtgatgatcggtccgggattcggtcagcgtggtatcgacggtaagttcgttgccatcaaatatacacgtacacatgatataccgaccttcggtatctgtctgggtatgcaatgtatcgctatcgaatttgcccgcaacgtattgggatatgccgatgccgactcacgcgaaatggatgaaaagactccgcacaacgtgatcgacatcatggaggaacagaaagcgatcaccaatatgggaggtacgatgcgtctgggcgcttacgaatgtgtgcttcagaaaggatcgaaagcataccttgcttatggtgaagaacatattcaggaacgtcaccgccatcgctatgagttcaataatgactataaggctcaatacgaagctgccggtatgaaatgcgtgggtatcaaccccgaatcggatctggtggaaatcgttgagatcccggcattgaagtggtttatcggcactcagttccatccggaatacagcagtacggtattgaacccgcatccgttgtttgtggctttcgtgaaggcagccatcgagaacgagaagaattgacaattgacagttgacaattgacaatttattattcaaaaatttataattcataattaataggaatggataaaaacaccattacaggtctcgttttaataggtatattattggtaggattcagttatctgagccgtccaagcgaggagcagatagctgcgcagaagaaatactacgattctattgccgtggtgcaacagcagcaggaagcgctgaaagcaaaaacagaagccgcactcgccaatgaaaacaaaggtgcagcggcggcagcagattcttctgccctgtttttcaacgcgatgcatggaactgattccaaagtaagcatccagaacagcgtagcggaaatcactttcactacgaaaggcggacgggtatattcggctatgctgaaagaatacaaaggacaggacaagacaaaccctgtcgtactgttcgacggtgatgatgctaccatgagtttcaacttctacaacaagcaaggagccatccagacaaaggactattacttcgaagctgtcaataagacagacagcagcgtaactatgcgtctggctgcggacaacgccagctacatcgattttatctatacgctgaaaccgaacagctacctgatgaactttgaaatcaaagcaacaggcatggaaggcaaactggccagtacggagtatgtagacatcgactggacacagcgtgcacgccagctggaaaagggattcacttacgaaaaccgcctctcagagctgacttataaggtaaaaggtgacaatgtagataatctgtcggctgccaaggatgacgaaaaggatctgggcaatacagcgatagactgggtagcattcaaaaaccagttcttctcttctgtattcatcgcagaccaggacttcaacaaggtttctgtgaagtcaagaatggaacaacaaggaagcggatatatcaaggattattctgcagaaatgagtaccttcttcgatccgagcggaaaacaaccgacagaaatgtacttctactttggcccgaaccacttcaagaccttgaaggcactggacaaaggacgtacagagaaatgggaacttaacagactggtatatctgggctggccgttaatccgctggatcaaccagtttatcacgatcaacgtattcgactggctgtcgggctggggcttgagcatgggtatcgtactgttgattctgacaatcatggtgaaggtggtagtttaccctgctacctggaaaacatacatgtcttctgccaagatgcgtgtattgaaaccgaaaatcgacgagatcaacaagaagtatccgaagcaggaagatgcgatgaagaaacagcaggaggtgatgagcctttacagccagtatggcgtgagcccgatgggcggttgtctgccaatgttattgcagttcccgatcttgatggcattgttcatgttcgtaccgagcgctatcgagttacgtcagcagagcttcttgtgggcggacgacttgtccacttacgacgcgttcatcacattcccgttccatatcccgttcctgggcaaccatctcagcttgttctgcttgctgatgacggtaaccaacatcctgaacacaaagtatacaatgacgatgcaggatacaggagcacaaccgcaaatggctgcgatgaaatggatgatgtatctgatgccgattatgttcctgttcgtactgaacgactatccttcgggattgaactattattatttcgtgtcaacactgattagtgtaggaaccatgattttgttgcgtaaaactacagacgaaacaaaattactggctattctggaagctaagaaaaaagacccgaaacaaatgaaaaagaccggatttgctgcacgcctggaagctatgcaaaagcaacaggaacagttacagcagcaaaaacagaataaacgataagaaattatccgaagatatattctgagaaagccgggcaaccgaaaggggtttgtccggctttctttctctaaaaaacaaacttaatatgaagacaaaatatacttataaacaaatctggacgatcgcctaccctattctgatcagcctgattatggagcagctgatcggcatgacggacacggcctttcttggacgtgtcggggaaattgaattaggggcatccgccatcgccggggtttactacctggctattttcatgatggcattcggattcagcgtaggagcacagatattgatcgcccgtcgcaacggggaaggaaactacaaggaaatcggaccgattttctatcaggggatttatttcctggtagtggttgctgcgattctgtttacactttccatcgtattctcgccatttattttaaagaatatcatttcgtcccctcacatttatgatgcagcggaaagttatattcattggcgggtgtacgggttctttttctcatttgtcggagtgatgttccgcgccttctttgtcggtacgacacagaccaagacgctgacgctgaactccatcgtgatggtgctttctaacgtggtattcaactatatcctgattttcggtaagttcggtttcccgcaactgggcattgccggtgcagccatcggttcatccctggctgagctggtatcggtgattttctttatcatctatacctggaagcggatcgactgcaagaagtatgcactgaatatcctgccgaaattccaaagccggacattgaagcggattctcaatgtctccgtgtggacaatgattcagaacttcgtttctttatctacctggtttatgttcttcctgttcgtggaacacctgggagaacggtcattggctatcgcgaacattatccgaaatgtgtcgggcatcccgtttatgatcgccatggcttttgctgcaacctgcggatctctggtcagcaaccttatcggtgcgggcgaaaaagattgtgtacggggaaccatcaatcagcacatccgtatcggatatgtgttcgtactgccgatattgatattcttctgtctgtttcccgacctgattctgcgcatatacacggatatgcccgatttgagggatgcgtccatcccttctttatgggtgttatgcgcagcctacgtagtgctggtaccagccaatgtgtatttccagtcggtatcgggaacaggtaacacacgcacggcactggccatggaactttgtgtactgacaatttatgtagcttacgctacttattttattctttaccttaaaatggacattgcgtttgcctggacaacagaaagtgtgtatggaatctttatcttcctcttctgctactggtatatgaagaaaggaaactggcagaaaaagcagatttaaatccttttttcattatcttcgcaagaaaataaacatttttataaaatatgagacaagcaaatctatttatgatgtcggcagcaatgttgttagctgcctgcggcggaacaaaagacgcgggcaaaacggatcaggtgcttatcgaaaaatccgatattaagatcgaagggaagcgtatgacgcctgaagccctttgggcaatgggacgtatcggaggactggcggtatcgcccgacggaaagaaaattgcgtatacggtagcatactacagtgtaccggagaacaagagtaatcgcgaagttttcgtcatgaacgcggacggcagcgataaccggcaaatcacccgcactccttatcaagagaatgaggtgacctggataaaaggaggaacgaagctggctttcctgagcaacgacaacggaagcagccaactatacgaaatgaatccggacggtagcggccgtaaacaactgaccaactacgacggtgacatcgagggttattctatctcaccggacggcaagaaactgctgttcatctcgcaagtgaaaaccaaagaaagcactgccgataaatatccggatctgccgaaagctacaggtattattgtcaccgacctgatgtataagcactgggatgaatgggtgacaactgctccgcatcctttcgtggcagactttgacggtaacggtatttccaatatcgtggatatactggaaggagaaccatacgaaagtccgatgaaaccttggggcggcattgagcaactggcatggaatatgacttcggacaaagtggcttatacctgtcgcaagaaaacagggctggaatatgctgtttctaccaattcggatatttatgtgtatgatctgaatacaaagaaaacggataatatcactgaagaaaacaaggggtatgacaccaatccgcaatactctccggatggcaagtacattgcatggcaaagtatggagcgcgatggatacgaagctgatctgaaccgtttgtttatcatgaatctggaaaccggagagaagcgttttgtcagcaaagcatttgagtctaatgtggatgcgtttgtctggggcaacgatgccaagaccatatattttacaggtgtatggcacggagaaactcagatttattctcttgacctgacgaatgattctgtaaaggcgattacttcgggtatgtatgattatgaaggggtagcactcttcggtgacaaactgattgccaaacgccactcaatgagtatgggtgatgagatctatgcggtagcattggatggttctgccactcaactgacacaggagaacaaggagatttatgatcagctggaaatgggcaaggtagaaggtcgctggatgaaaacgacggatggcaaggatatgttgacatgggtgatctatcctccccagttcgatccgaacaagaaatatccgacattgctgttctgtgaaggtggtcctcaaagtccggtaagccagttctggtcttatcgctggaacttccagattatggctgccaacgactatatcattgtagccccgaaccgtcgcggattaccgggattcggagtggaatggaacgaacagatcagtggtgattatggtggtcagtgtatgaaagactatttcactgctatcgacgagatggcaaaagaatcgtatgtagataaagatcgtctgggatgtgtgggcgctagtttcggaggattctccgtatattggttagccggtcatcacgacaaacgtttcaaggcatttatcgctcatgacggaatcttcaatatggaaatgcagtatctggaaacagaagagaaatggtttgccaactgggatatgggcggcgcgtactgggaaaaacagaatccgatagcacaacgtactttcgccaactcccctcacctcttcgtggaaaaatgggatactccgattctctgtattcatggagaaaaagatttccgtattttggctaatcaggctatggctgcatttgatgccgctgtaatgcgtggtgtacctgcagagttgctaatttatccggatgaaaaccactgggtactgaaaccgcagaatggtgtcttgtggcaacgcactttctttgagtggctggataagtggctgaaggctcctgcaaaataaatcattgatataagacaaataatgaaggctctgttctcaaatcaaattgagttcagagccttctgcattacatctaaaatccgctagactttactcatgatatatattttcgattgctactatatacttagataaggtctatgattcaatctagacctgtttcataatccttttcaaatagctcaatcggagcctccattaaaacagttttttcagcacctttttcgtctgataaatcaattaatcccattttttgctcccttaattgttctccagtccatctgccttttaaatggtattcttcccctttatttacggccttcagtaccaaataaaaagttaaggtacatcgatatccacattcttgttttgttaactcataaattgaatagggaggtatctcatactttacatttccaatagaacgtgatccattctttacttttaatgtttctccaaaaatcaacggagtcttcgcacccgttccgtctataaaaagcttacctccagcatcaatgaaaggaacaggaatcttcaaatccgccaaattttcagcattaacaggcaaagaaccttcagtcaatacaaataaagagttctcttcctcttccacatcccatgcatatatcattggaagaggttcatctttatcatttactttatgttgcaagactactacaggatattcaacccgctctactacatccgtttcctcctgcacaaacttataggaaacaacctctaatatcgccggagcattggatggagaagaagacacatcatccgaatcactactacaagctgcgagtgcagcacagatacctgcaagaaagaacatttttgttttcataacgcttagttttagttgtgttacaatagtttagtttagggcaaatgtataatatttatatcacttatcaaagctttaccgataaaaaataaaaaaagggagaattaatctccctcccaaatattttcgatttctactatatacattttatgaaaacctccatgagcatcgtcataccatttttccaaggactctttatccaagaaacattcgggtttaatagtatctgtatagagcttcttgcattccaaacttagacgggcttgttcgaaaagcacattcccctgttctgtgaagaccggcttcaatccggttgctttcaccttatccgtatcacgaccggactttgagccacagaccgcatgaatcttcttatttgcttcgcccaaaaaagaaagtgtcagataatcacttttctcgatgaactcatacgtatatcgttcggggcggacaaaaacaaaagcaacgggctcattccaaagccagccaataccaccccaactggcagtcattgtattgaatttctctttggtgccggcagtaaccaacatccattctttgccaatcgcctcaaagaaattttctttcaggtcttttacttctaacttcttcatctctcagtttattttataattactttcttttactcagttttacgatttctcccagataagggatttccacacgaatctttcttttctttgcttctgccgcaaatactttaggcggatcatgcaagggttcatcagacaaatcaaatgtaccgtagtgcatcggaatggttattcctgcatgcatctcttcggaggcagtcagtgattcataaggggaaatatgattgggacgcatgaaccaacggggtttatatgcaccaatacccaacaaggcatagtccggagctccgaacagatccgggatttccctaaaatgggtagaataccctgtgtctccgctataatagagagaaacaccattcccctgcagcatgaaagctccccacaatcgctgccctccatcacgtacggaacgtttgctccaatgctgtgccggcaagaaagttattttcagcccctcattttccagttgctgataccagccggcctcgatcactctcatttccggaaaccagctctttatcagttctccggttcccaaaccgcaaaacagtttcatctgcggattattattcagcaaacgggtgatactttgcttgtccagatggtcaaaatggtcatgactgataagcaggtaatcaatttctgtaaaaatgtcgggattggcaggaaactcactctgtcttttcacaaaagggatgtttccgaaaaccggatcgaacatgattcttttgcctgccaactgaaggaagaaggaattatgtcccagccatattaaagaatctcccaccacagcatccagcgaacgaaggtaacagactttcgggtcccacttcaccgttttcttttctttccgctgaggattgggggacaaccgccatttcaacacacttcccataccggggcggaaacggtgctgcctgttaaaaaaacgtccgcgtaccatcggatttcctctccaataaggattgacggtagccaaacgttcgtttctcctgaaacatatatgttcacccattttctttatctattgaataagtcctcacaaacttaattaaaaatctcgatttacaaagagggacaaacaaaaaatgtaccccggacacactatcggggcacatttctcagaaaaagaataaatattattcttttttaatagaacgatcttacattaaaagcaatgcagtccatacaacggcagctgccatccgagagctgacaaattgataatcacgatgaccagtcccaatacccataggataaacagagaccatttcaagccggtccccatcggtgaccaatgaaacaactgacgcattatagtgtacagaaaagctcctaatggaatggcaatgagtgcaattcctgaaatggtgccaagcaatgtcatcacaggagatatggtagctatgggcgtccagtcaatagccggaagcatttcataaagcagagctccaccgccaacaagcgcagcaatcaccgcaaacacaagagctactatcaccacagcgagcacgaacaataccggacagcaaatgatgacaagagctaccaggaatatcttaagaatgatagcggcgatcgtgacaaatacatctcctactttttgcagaaaggtacgcggtttatccgagttcacaaagttattgaccccgtcggccacccgttcaaatccgtccgtcaccgttttgcctatattttctatggttaccgcttcgccacgcatactcagcttctctgctgccgtacgtgcttcgggaatgataatccatcctataatataaaggataatcatcgggcaatagggaacaaacaataatacgatcatcaggatacgcaccaacgtgatatcccagtcaaaataagctgccagcccggaagctactcccccaagcaacttattatccggatcacggaacaggcgacgggctgtagtggtccgtgtatatccctgaccggaagaagctgtctgttccttcttatgcggttcggattcgtcgtcagatacaccaaaatcttccggtttgcctacccgggcaattatttcttccacatcggcaatagtaatgacttgcttccctgcggacactttctcggcaaacagctcggcaatacgaatctcgatatcattcacaatctcttccgccccctcctgtttgcgaaaaaaatgtttcaggttggccagatagtcgtccagcaagcggtaggcatcatcatctatatgatagacagttcctcccaaatttacagtcaatgtttttttcattattatttcttctttatcgaattatctactagcaatatgattcacggtttcgttcagttccttccaggatatctcaagctcgcctaaaaaagcctctcctttttctgtgagcttatagtacttgcgaggaggtccctgcgtggattctacccattcataactcaacaaatcgtcattcttcaaacgtgtcagcaatggatataaggtaccttccaccacaatcagctgtgcctctttcaacttctgaataatatcagaagcataagccggctctttgtgcagtaaaagcatgatgcaatactccaacatgccttttctcatctgagattttacattgtctacattcattgttatttttctttttgacaggacaaatatatgcattactctagtaccttgcattacaaagtactataatttaataataattaaatcattaagaagttttctccttattataaaaagaaataatagctatatttgcagctcataaaaccacaaaaaagaaaatacgtatgtttactattcgaaaagcaaggatagatgattgcggtctgatcaaccaaatggccggtgaagtatttcccgccacttaccaagagatcttatctcccggacaactggactatatgatggactggatgtactctcccgaaaatatccggaaacaaatggaagaagaaggtcatgtttattttatcgcatatgaaggagatgagccctgtggctatgtctccgtacagcaacaggaagagaatgtattccatctgcagaaaatctatgtcctcccccattttcaaggcgcacactgcggtagttttttattcagagaggctgtcagatatatcaaggaggtgcatccggaaccttgcttaatggagcttaacgtgaaccgtaacaacaaggctttactgttctatgaacggatgggtatgagaaaattgcgggaaggggattttccgattggcaacgggtactatatgaatgattatatcatgggactggatatctgaaaagtaaggtaaccatatacaaaatgccccggaacagattgttactcaatcaatgttccggggcattcgtttatttattaccaagcgggcttatttcgctacgcgttccagccatttcagcatgaagatcatggtaaacattgaaatagtacaagctaccacaaatactgtccatgtcatccagataggaatggattcatacaaaatagcaccgatcaccaacagctgattgccaagtgcagtcgcacctaaccagcctccctgcataataccctggtatttcggaggagctactttagacacaaatgaaattcccaacggagaaatatacaattcagctaccgtcaaaatcagataagtcagcatcaacaagaacggagtcactttcaccggtgaagttcctacagcgataatgtccttgtgcaaaggcagattggcaaaataagaaccgacagccattacgataaaggccaatgcggcaatacccataccaattgcaatcttcttaggagtagaaggctcttttccacgtctgcgctggctggcaaagattgccataatcacaggagtcaggaaaacaacaaagaacggattcaacgactggaacaactcagcggaaataggcataccaaacaagttaaggtcagtgtattcctttgcaaagtatgtcaaagtcaaaccattctgatggaaagagaaccagaagaagataacaactccgaacactgcgaacagggcatacatacgttgtttcacttcctgaatactcatttctacagtagccgaagatgctgaagacgcaacggctttcttgctgggatcggggaagtttctcttattcagcaaatagatagtcaaagaaatgaccatagcaatgatagccactccaaatgcataatggaaacctgtagtaaagacgttcaggtaatcggatgcaaaagctgtataatcctgtaccggagcgttggaagctttctctaccaacgtatgataagtttcagtagcttcgggcgacaaagtaccagccaaatgaccgtgacataatgcaggaagatcagcatcgtaattataaccgaaagtagacaaccaccagttacgtacacctaccgctgcaaacggagcaaagattgcaccgatattaatgaacatataaaacaaggagaaaccggagtcacgcatgctggcatattgaggattatcgtacatctgccctaccagagcttgcagatttcctttaaataatccattaccaaatgcaatcacaaacaagctggcgcaagtaatgaccagataaaaggtctgattgtctaccggagtcttggatggaatagccaacaacaagtatcccactgccatcagcacaattcccgtgaaaatagttcctttgtagtttcgtgtcttatcggcgataatacctccaaccaaagcaagaatgtaaatggaaaaatagaaagttgaataaataaatcccgcttcttttccattcattccaaacttagcttgcaagaaaagcacgaggatcgccatcattgtatagaagccaaagcgttcacctagattggctaaagcggctgctatcagtcctttagggtgtttgtcaaacatagatataaatttattaattaatgattgataatttttctaatgacatatattctgcaaatatatacttttttggatttattcctcaaataaacggcaaatttctgccctcgattcgcggattaaatcacccggcgcaagctttatctgcagcccccgtacaccggcacttacataaatatacggaaattgccggcaggtttcatgaatataagtaggaaaatgtttcttcatgccaataggcgaacagccgccccggatatatcccgtcagcggaagaagttctttcaccggtatcagatcacactttttattgccggaagcctttgctgccagcttcagatcgacttcgtgctcacccggaatgacgcaaacaaaataaccgcttttgtcaccgtgaagaaccagtgtcttaaatacctgttctatattctcgcctaagctggcagctacatgaatggcactcagatcgttttcgtcaacttcataaggaatcagttcataagctattttagctttatccagcagacgcgccgcattcgttttattgattttcatcttgttgtttctttttagtaagccgacacttatacttcaatattaaagtcctaattcctcgcgaagaaacttaggagtataacctttctggctcttcgcaacctcttccggtgttccgtagctaaggagtactcccccgcccttaccaccttcaggtcccatgtctatgatataatccgccatcttgataacgtccaggttatgttcgattacaatgacggtattacctttgtccaccagcttattaagtacccccatcaatacacggatatcctcaaagtgaagtccggtagtcggttcatcgagaatgtaaagtgttttaccggtatctcgcttggacaattctgttgctagtttcacacgctggctctctccaccagaaagggtagtagatgactgccctaatttaatatagcccaaaccgacatcctgcaagacttttatcttattcagaatctgcggcacattctcaaagaattcgacagcacggtttatagtcatatcaagcacatcagcaatagactttcctttgaaacgtacttcaagcgtttcgcgattataccgcttgccgtggcaaacctcacaaggcacatacacatccggcaagaagttcatttcaatcgtcttgtatccatttccggtacaggcttcacaacgaccgcccgatacattaaaagagaagcgtccgggcttgtaaccgcgaatcttagcttccggaaggcttacgaacaagttacggatatcggaaaatacacctgtataagtggccggattggaacggggggtacgaccaatcggagattgatccacgtccactaccttatctatgttttccagtccctctatagaatcgtattccagaggatcctgcaaagagcgatagaatttctgtgaaagaatcggctgcaaagtctcattaatcaacgtcgatttaccacttccggatactccggtcacacaaatcaacttccctaacggaaattcaacatctacatttttcagattatttcccttcgctcctttcagccagatagattttccatttccttttcttcgcttggcgggtacttctattttcatctctccgttcagatactgcgaagtcatcgtttcggtttgaagcatttctgacggggttcccgagaagactacctccccacccagacgaccggctttaggccccatatcaatcacataatcggcagccagcatcatatctttatcgtgttcaacaacgataaccgagtttcccatatcacgaagctctttcaacgagcggatcaaacgcagattgtcacgctggtgcaacccgatactcggttcatccagaatataaagcacattcaccaattgcgagccgatctgtgtagccagacgaatacgctgactttcaccaccggacaggctgaccgagctacggttcaatgccaaataatccaatcctacatccaacaagaatttcaaacgcgtacgaatttctttcagaatctcggctgcgattttcttttgtttatcggacagaaattgatctacgttcatcaaccagtcatatagctcattgatgtccatattggccaagtcattgatgttcttgtcatgaatacggaagtgcaatgcttctttattcaaccgggcacctttacattccggacaaacagtggtacgggcaaactgctccgcccacttctgcgcggtagcagaagcatccttttcctgaagcatctggatatattttacgactccttcataggttacaaagtaatcagaagaagttcctatcagcgaactcttgatcttgatccggtcatccgaaccatataatatttcttcaaccgcatcatccgacaattccttcaccggagtttttaaagtggcttcatacttctccagcaaagcaccgatctgccagaaaatcatggcattcttgtattttcccaaaggtgctatcgctccttcatagatggaaagttcacggtcgggaatcactttatcgacatcaatctgattgaccacgcctaatcctttacatttcgggcacgctccctgcggagagttgaacgagaagttatgaggagccggttcccgataagacagtccggtaaccggacacatcaggcgtttactgtaatgacggacactttctgtctgcgcatcaagaatcatcaataaaccatcaccttggcgcatagcagttgccacgctctgtttcaggcgtttatcatctttctcggctactatcagtttatcaatgactacctcaatatcatgattcttgtaacggtcgagtttcatgccgtgcgtcacttcacgcagttcgccgtctatccgtacatagagatatcctttctttcgcacctgttcgaagagttctttgtaatgtcccttacgcgaacgaaccaagggtgcgagcaagtatattttctttcctttataatctttcaggattaaatccagaatctgttcttccgtatatttcaccatctcctctcctgacaggtacgaataagcaatacctgcacgggcatagagcagacgaagataatcgtatatttccgttgttgttcccacggtagaacggggatttttattcgtagttttctgttcgatagagataaccggactcagccctgttattttatcgacatccggacgttccagattccccaaaaagttgcgggcataggccgaaaaagtctcgatatagcggcgctgtccctcggcaaatatcgtatcgaaagccaaggaagatttaccactaccactcaatccggtaatcactgtcaaactgttacggggaatttcagcatcaatatctttcaaattgtgcacacgggcaccatacacattaatatattctgtttcttgcatattcatatccttcataaacggtacaaaattaatgtttccgactgaaatatgctcctaaaaaagcacaatattattttcttaactcaaatcttatgaagatatagggcattattcgtacctttgttccttgatttcaagaaccaatagttataaattgatgaaaccgataagccgaatattcttatttttgctttttataagcgcctcatacgctattagttatgcacaagagaaccaatcttatttcttgcataccatcgaaaaaggacagagtttatactccattgccaagatgtataatgtcacaacaaacgacatcatacgtctgaatcccggatgtgatgaaaaaatttatgccggacaagctataaaaatccctaaaggaaaagaaagccaaaaaggggaaacattccatacaattcaagccggagaaactttatacaaactgactaccatttataatatatctgcaaaagccatttgtgaagccaatccgggattaagcgccgaaaacttccgtatcggtcaggttattctcattccgttggaacaagagcaggaaacggaaactgcacaagcaccggctgaaaaacccgctatacaggggcctgtacaatccagatgcaaagatatgcataaggtaaaacgcaaagaaaccgtattcagtgtaagccgcgaatatggaatcagcgaacaggaattgattgcagccaatcccgaactgaaaaagggaatgaaaaagggacaatacctctgtatcccctatcccagtgcaaccaccatgcaaccgacggctcccaaagaggatccgtacgctatcccacccagtaacaatgagcttttccgcaagagtaaagaagcccctcaagcaatctctactatcaaagcggccctgctattgcctttccaggaagacaaacgtatggtggaatactacgaaggtttcctgatggcggtagacagcctgaaacgtacgggtacttctattgatctatatgtatatgactgtggaaaagatgtttctacattaaatactattctggcgaaaaatgagatgaagaacatgaatgtcattttcggtccgatgcaccagcaacagatcaaacctttatctacttttgcagaaaagaatgatatacgactggtgattcctttctcttcgaaaggggaagaagtatttaataatcctgccatctaccagattaataccccgcaatcctatttatattcggaagtatacgaacactttacccgtcaattccccaatgcccatgtcatctttattgaaccaaccagcgaagataaagaaaaagccgagtttatcagcggcatgaaacaagagctgaagagcaagggaatgtcaatgaaaaccgtcaatgaaaacgcaaccaaggatatgctgaaggaagctctccgctctgacaaagacaatattttcattccgacttccggcaaaaatgtcatgttaatcaagattcttcctcaactgattctactggtcagagatactccggagcagaatattcatctgttcggttatcccgaatggcagacatatacccgggatcacctggaaagtttctttgaactggatacctatttctattcatcgttctacacaaatacattgtttccggctgccatacagttcaccaacaattatcacaaatggtatagcaaggacttggtgagtaaattcccaagctacggaatgcttggtttcgacacaggcttcttcttcctgaaaggcttgtcacgctatggctcggaactggaaaacaatttaccgaaaatgaacctgactccgatacagacaggcttcaaattcgaacgtgtcaacaactgg
